US008847008B2

(12) United States Patent
Emmanuel et al.

(10) Patent No.: US 8,847,008 B2
(45) Date of Patent: Sep. 30, 2014

(54) ISOLATED POLYNUCLEOTIDES AND POLYPEPTIDES AND METHODS OF USING SAME FOR INCREASING PLANT UTILITY

(75) Inventors: Eyal Emmanuel, Rechovot (IL); Alex Diber, Rishon-LeZion (IL); Evgenia Gold, Rechovot (IL); Inbar Nevo, Tel Aviv (IL); Basia Judith Vinocur, Rechovot (IL); Sharon Ayal, Kiryat-Ekron (IL); Gil Ronen, Emek Hefer (IL); Yoav Herschkovitz, Givataim (IL); Michael Gang, Jerusalem (IL); Dotan Dimet, Tel Aviv (IL); Anat Idan, Azur (IL)

(73) Assignee: Evogene Ltd., Rechovot (IL)

( * ) Notice: Subject to any disclaimer, the term of this patent is extended or adjusted under 35 U.S.C. 154(b) by 394 days.

(21) Appl. No.: 12/992,902

(22) PCT Filed: May 21, 2009

(86) PCT No.: PCT/IL2009/000508

§ 371 (c)(1), (2), (4) Date: Dec. 20, 2010

(87) PCT Pub. No.: WO2009/141824

PCT Pub. Date: Nov. 26, 2009

(65) Prior Publication Data

US 2011/0097771 A1 Apr. 28, 2011

Related U.S. Application Data

(60) Provisional application No. 61/129,296, filed on Jun. 17, 2008, provisional application No. 61/071,885, filed on May 22, 2008.

(51) Int. Cl.
*C12N 15/82* (2006.01)
*C12N 15/87* (2006.01)

(52) U.S. Cl.
USPC ............................ 800/278; 800/290; 435/468

(58) Field of Classification Search
None
See application file for complete search history.

(56) References Cited

U.S. PATENT DOCUMENTS

| | | | |
|---|---|---|---|
| 3,791,932 | A | 2/1974 | Schuurs et al. |
| 3,839,153 | A | 10/1974 | Schuurs et al. |
| 3,850,578 | A | 11/1974 | McConnell |
| 3,850,752 | A | 11/1974 | Schuurs et al. |
| 3,853,987 | A | 12/1974 | Dreyer |
| 3,867,517 | A | 2/1975 | Ling |
| 3,879,262 | A | 4/1975 | Schuurs et al. |
| 3,901,654 | A | 8/1975 | Gross |
| 3,935,074 | A | 1/1976 | Rubenstein et al. |
| 3,984,533 | A | 10/1976 | Uzgiris |
| 3,996,345 | A | 12/1976 | Ullman et al. |
| 4,034,074 | A | 7/1977 | Miles |
| 4,098,876 | A | 7/1978 | Piasio et al. |
| 4,666,828 | A | 5/1987 | Gusella |
| 4,683,202 | A | 7/1987 | Mullis |
| 4,801,531 | A | 1/1989 | Frossard |
| 4,879,219 | A | 11/1989 | Wands et al. |
| 4,943,674 | A | 7/1990 | Houck et al. |
| 4,945,050 | A | 7/1990 | Sanford et al. |
| 5,011,771 | A | 4/1991 | Bellet et al. |
| 5,187,267 | A | 2/1993 | Comai et al. |
| 5,192,659 | A | 3/1993 | Simons |
| 5,268,463 | A | 12/1993 | Jefferson |
| 5,272,057 | A | 12/1993 | Smulson et al. |
| 5,281,521 | A | 1/1994 | Trojanowski et al. |
| 5,296,462 | A | 3/1994 | Thomashow |
| 5,316,931 | A | 5/1994 | Donson et al. |
| 5,356,816 | A | 10/1994 | Thomashow |
| 5,399,680 | A | 3/1995 | Zhu et al. |
| 5,464,765 | A | 11/1995 | Coffee et al. |
| 5,466,785 | A | 11/1995 | De Framond |
| 5,495,070 | A | 2/1996 | John |
| 5,504,200 | A | 4/1996 | Hall et al. |
| 5,521,708 | A | 5/1996 | Beretta |
| 5,569,597 | A | 10/1996 | Grimsley et al. |
| 5,597,718 | A | 1/1997 | John et al. |
| 5,604,121 | A | 2/1997 | Hilder et al. |

(Continued)

FOREIGN PATENT DOCUMENTS

| | | |
|---|---|---|
| AU | 2005229157 | 10/2005 |
| AU | 2005234725 | 12/2005 |

(Continued)

OTHER PUBLICATIONS del Pozo et al (2000), Plant Mol Biol 44(2): 123-128. Abstract referenced.*
Harwood, J (2010) Lipid Library Website. Plant Fatty Acid Synthesis. Webpage converted to PDF.*
Backhaus et al (1994) Plant Physiology 106:395.*
Theologis et al (2000) Nature 408: 816-820.*
Ciddi et al (1995) Biotechnology Letters 17 (12):1343-1346.*
University of Colorado, Bioinformatics website. Terminology FAQ list (2001).*
Lurin et al (2004) Plant Cell 16 (August): 2089-2103.*
*Arabidopsis* Genome Initiative (2000) Nature 408 (Dec): 796-815.*
Doerks et al., (TIG, 14:248-250, 1998).*
Smith et al. (Nature Biotechnology, 15:1222-1223, 1997).*
Bork et al. (TIG, 12:425-427, 1996).*

(Continued)

*Primary Examiner* — Vinod Kumar

(57) ABSTRACT

Provided are isolated polypeptides comprising the amino acid sequence at least 80% homologous to SEQ ID NO:68, 51-66, 69-100, 379-656, 707-715, 720-723, 742-754, 764-771 or 772 with the proviso that the amino acid sequence is not as set forth by SEQ ID NO: 765 or 771, isolated polynucleotides comprising the nucleic acid sequence at least 80% identical to SEQ ID NOs:18, 1-16, 19-50, 101-378, 657-672, 674-706, 716-719, 724-741 and 755-763 with the proviso that the nucleic acid sequence is not as set forth by SEQ ID NO:756 or 762, and isolated polynucleotides selected from the group consisting of SEQ ID NOs:779-792 and methods of using same for increasing oil content, yield, growth rate, biomass, vigor, abiotic stress tolerance and/or nitrogen use efficiency of a plant.

10 Claims, 3 Drawing Sheets

(56) References Cited

U.S. PATENT DOCUMENTS

| | | | | |
|---|---|---|---|---|
| 5,608,142 | A | 3/1997 | Barton et al. | |
| 5,608,144 | A | 3/1997 | Baden et al. | |
| 5,608,149 | A | 3/1997 | Barry et al. | |
| 5,608,152 | A | 3/1997 | Kridl et al. | |
| 5,620,882 | A | 4/1997 | John | |
| 5,659,026 | A | 8/1997 | Baszczynski et al. | |
| 5,693,507 | A | 12/1997 | Daniell et al. | |
| 5,859,330 | A | 1/1999 | Bestwick et al. | |
| 5,880,100 | A | 3/1999 | Ogiso et al. | |
| 5,961,466 | A | 10/1999 | Anbar | |
| 5,981,834 | A | 11/1999 | John et al. | |
| 6,080,914 | A | 6/2000 | Conner | |
| 6,084,153 | A | 7/2000 | Good et al. | |
| 6,094,198 | A | 7/2000 | Shashua | |
| 6,167,151 | A | 12/2000 | Albeck et al. | |
| 6,201,541 | B1 | 3/2001 | Shalom et al. | |
| 6,313,375 | B1 | 11/2001 | Jung et al. | |
| 6,313,376 | B1 | 11/2001 | Jung et al. | |
| 6,359,196 | B1 | 3/2002 | Lok et al. | |
| 6,392,122 | B1 | 5/2002 | Clendennen et al. | |
| 6,403,862 | B1 | 6/2002 | Jiao et al. | |
| 6,442,419 | B1 | 8/2002 | Chu et al. | |
| 6,472,588 | B1 | 10/2002 | Haigler et al. | |
| 6,670,528 | B1 | 12/2003 | Shinozaki et al. | |
| 6,701,081 | B1 | 3/2004 | Dwyer et al. | |
| 6,720,477 | B2 | 4/2004 | Da Costa e Silva et al. | |
| 6,765,607 | B2 | 7/2004 | Mizusawa et al. | |
| 6,801,257 | B2 | 10/2004 | Segev et al. | |
| 6,850,862 | B1 | 2/2005 | Chidichimo et al. | |
| 6,965,690 | B2 | 11/2005 | Matsumoto | |
| 7,072,504 | B2 | 7/2006 | Miyano et al. | |
| 7,214,786 | B2 | 5/2007 | Kovalic et al. | |
| 7,292,719 | B2 | 11/2007 | Arnon | |
| 7,554,007 | B2 | 6/2009 | Ronen et al. | |
| 7,812,218 | B2 | 10/2010 | Ronen et al. | |
| 7,910,800 | B2 | 3/2011 | Karchi et al. | |
| 8,049,069 | B2 | 11/2011 | Wu et al. | |
| 8,168,857 | B2 | 5/2012 | Ayal et al. | |
| 8,426,682 | B2 | 4/2013 | Ronen et al. | |
| 2001/0046316 | A1 | 11/2001 | Miyano et al. | |
| 2002/0046419 | A1 | 4/2002 | Choo et al. | |
| 2002/0049999 | A1 | 4/2002 | Allen et al. | |
| 2002/0148007 | A1 | 10/2002 | Jiao et al. | |
| 2002/0160378 | A1 | 10/2002 | Harper et al. | |
| 2002/0170088 | A1 | 11/2002 | Wilkins | |
| 2003/0005485 | A1 | 1/2003 | Ohlrogge et al. | |
| 2003/0074697 | A1 | 4/2003 | Allen et al. | |
| 2003/0084485 | A1 | 5/2003 | Zhu et al. | |
| 2003/0162294 | A1 | 8/2003 | Verbruggen | |
| 2003/0163839 | A1 | 8/2003 | Helentjaris et al. | |
| 2003/0233670 | A1 | 12/2003 | Edgerton et al. | |
| 2004/0006794 | A1 | 1/2004 | Wilkins | |
| 2004/0019927 | A1 | 1/2004 | Sherman et al. | |
| 2004/0031072 | A1 | 2/2004 | La Rosa et al. | |
| 2004/0034888 | A1 | 2/2004 | Liu et al. | |
| 2004/0123343 | A1 | 6/2004 | La Rosa et al. | |
| 2004/0172684 | A1 | 9/2004 | Kovalic et al. | |
| 2004/0181830 | A1 | 9/2004 | Kovalic et al. | |
| 2004/0236225 | A1 | 11/2004 | Murphy et al. | |
| 2005/0096515 | A1 | 5/2005 | Geng | |
| 2005/0108791 | A1 | 5/2005 | Edgerton | |
| 2006/0048240 | A1 | 3/2006 | Alexandrov et al. | |
| 2006/0101543 | A1 | 5/2006 | Somerville et al. | |
| 2006/0107345 | A1* | 5/2006 | Alexandrov et al. | ......... 800/278 |
| 2006/0123505 | A1 | 6/2006 | Kikuchi et al. | |
| 2006/0123516 | A1 | 6/2006 | Ronen et al. | |
| 2006/0137043 | A1 | 6/2006 | Puzio et al. | |
| 2006/0143729 | A1 | 6/2006 | Alexandrov et al. | |
| 2006/0150283 | A1* | 7/2006 | Alexandrov et al. | ......... 800/288 |
| 2006/0168684 | A1 | 7/2006 | Renz et al. | |
| 2006/0174373 | A1 | 8/2006 | Gipmans et al. | |
| 2006/0179511 | A1 | 8/2006 | Chomet et al. | |
| 2006/0183137 | A1 | 8/2006 | Harper et al. | |
| 2006/0195943 | A1 | 8/2006 | Feldmann et al. | |
| 2006/0206961 | A1 | 9/2006 | Cirpus et al. | |
| 2006/0260002 | A1 | 11/2006 | Ronen et al. | |
| 2006/0288451 | A1 | 12/2006 | Val et al. | |
| 2007/0006345 | A1 | 1/2007 | Alexandrov et al. | |
| 2007/0006346 | A1 | 1/2007 | Alexandrov et al. | |
| 2007/0044171 | A1 | 2/2007 | Kovalik et al. | |
| 2007/0044172 | A1 | 2/2007 | Schneeberger et al. | |
| 2007/0061916 | A1 | 3/2007 | Kovalic et al. | |
| 2007/0124833 | A1 | 5/2007 | Abad et al. | |
| 2007/0169219 | A1 | 7/2007 | Nadzan et al. | |
| 2007/0214517 | A1 | 9/2007 | Alexandrov et al. | |
| 2007/0261130 | A1 | 11/2007 | Lightner et al. | |
| 2008/0072340 | A1 | 3/2008 | Troukhan et al. | |
| 2008/0076179 | A1 | 3/2008 | Hartel et al. | |
| 2008/0148432 | A1 | 6/2008 | Abad | |
| 2008/0196120 | A1 | 8/2008 | Wu et al. | |
| 2008/0301839 | A1 | 12/2008 | Ravanello | |
| 2009/0089898 | A1 | 4/2009 | Karchi et al. | |
| 2009/0093620 | A1 | 4/2009 | Kovalic et al. | |
| 2009/0094717 | A1 | 4/2009 | Troukhan et al. | |
| 2009/0126042 | A1 | 5/2009 | Ronen et al. | |
| 2009/0260109 | A1 | 10/2009 | Ronen et al. | |
| 2009/0293154 | A1 | 11/2009 | Yelin et al. | |
| 2010/0154077 | A1 | 6/2010 | Emmanuel et al. | |
| 2010/0319088 | A1 | 12/2010 | Ronen et al. | |
| 2011/0080674 | A1 | 4/2011 | Durand | |
| 2011/0214206 | A1 | 9/2011 | La Rosa et al. | |
| 2012/0060234 | A1 | 3/2012 | Emmanuel et al. | |
| 2012/0084885 | A1* | 4/2012 | Alexandrov et al. | ......... 800/298 |
| 2012/0096587 | A1 | 4/2012 | Vinocur et al. | |
| 2012/0180164 | A1 | 7/2012 | Ayal et al. | |
| 2012/0222169 | A1 | 8/2012 | Ronen et al. | |
| 2012/0297504 | A1 | 11/2012 | Granevitze et al. | |
| 2013/0125258 | A1 | 5/2013 | Emmanuel et al. | |
| 2013/0167265 | A1 | 6/2013 | Panik et al. | |
| 2013/0219562 | A1 | 8/2013 | Ronen et al. | |
| 2013/0239255 | A1 | 9/2013 | Ronen et al. | |
| 2013/0276169 | A1 | 10/2013 | Poraty et al. | |
| 2013/0291223 | A1 | 10/2013 | Emmanuel et al. | |

FOREIGN PATENT DOCUMENTS

| | | |
|---|---|---|
| CN | 1823168 | 8/2006 |
| DE | 10150918 | 5/2003 |
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| EP | 2154946 | 2/2010 |
| GB | 2358752 | 8/2001 |
| JP | 2005-052114 | 3/2005 |
| JP | 2005-185101 | 7/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058963 | 7/2004 |
| WO | WO 2004/081173 | 9/2004 |
| WO | WO 2004/092367 | 10/2004 |
| WO | WO 2004/104162 | 12/2004 |
| WO | WO 2004/111183 | 12/2004 |
| WO | WO 2005/084331 | 9/2005 |
| WO | WO 2005/095614 | 10/2005 |
| WO | WO 2005/108422 | 11/2005 |
| WO | WO 2005/121364 | 12/2005 |

(56) References Cited

FOREIGN PATENT DOCUMENTS

| | | |
|---|---|---|
| WO | WO 2006/003658 | 1/2006 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2007/113237 | 10/2007 |
| WO | WO 2008/069878 | 6/2008 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/083973 | 7/2009 |
| WO | WO 2009/083974 | 7/2009 |
| WO | WO 2009/118721 | 10/2009 |
| WO | WO 2009/141824 | 11/2009 |
| WO | WO 2009/144311 | 12/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/128448 | 9/2013 |
| WO | WO 2013/179211 | 12/2013 |

OTHER PUBLICATIONS

Examiner's Report Dated Jan. 10, 2012 From the Australian Goovernment, IP Australia Re. Application No. 2005234725.

Aharon et al. "Overexpression of a Plasma Membrane Aquaporin in Transgenic Tobacco Improves Plant Vigor Under Favorable Growth Conditions But Not Under Drought or Salt Stress", The Plant Cell, 15:439-447, Feb. 2003.

Friedberg "Automated Protein Function Prediction—The Genomic Challenge", Briefings in Bioinformatics, 7(3): 225-242, 2006.

International Preliminary Report on Patentability Dated Dec. 2, 2010 From the International Bureau of WIPO Re. Application No. PCT/IL2009/000508.

Notice of Allowance Dated Oct. 18, 2010 From the US Patent and Trademark Office Re. U.S. Appl. No. 11/990,386.

Office Action Dated Nov. 11, 2010 From the Israel Patent Office Re. Application No. 206118 and Its Translation Into English.

Official Action Dated Nov. 23, 2010 From the US Patent and Trademark Office Re. U.S. Appl. No. 12/083,978.

Response Dated Dec. 5, 2010 to Office Action of Aug. 4, 2010 From the Israel Patent Office Re.: Application No. 172135.

Response Dated Dec. 12, 2010 to Examiner's Report of Dec. 17, 2009 From the Australian Patent Office Re.: Appl. No. 2005252469.

Response Dated Dec. 14, 2010 to Examination Report of Sep. 22, 2010 From the Instituto Mexicano de la Propriedad Industrial Re. Application No. MX/a/2008/005280.

Response Dated Sep. 14, 2010 to Official Action of Aug. 18, 2010 From the US Patent and Trademark Office Re. U.S. Appl. No. 12/083,978.

Response Dated Oct. 24, 2010 to Office Action of Sep. 2, 2010 From the ROSPATENT, Federal State Institution, Federal Institute for Industrial Property of the Federal Service for Intellectual Property, and Trademark of the Russian Federation Re. Application No. 2008120395.

Summary of Office Action Dated Sep. 2, 2010 From the ROSPATENT, Federal State Institution, Federal Institute for Industrial Property of the Federal Service for Intellectual Property, Patents and Trandemarks of the Russian Federation Re. Application No. 2008120395.

Translation of Office Action Dated Oct. 19, 2010 From the State Intellectual Property Office of the People's Republic of China Re. Application No. 200680038391.X.

Wang et al. "Control of Plant Trichome Development by a Cotton Fiber MYB Gene", The Plant Cell, 16: 2323-2334, Sep. 2004.

Wang et al. "Control of Plant Trichome Development by a Cotton Fiber MYB Gene", The Plant Cell, 16: 2323-2334, Sep. 2004. GenEmbl Database, Accession No. AY641990.

Examiner's Report Dated Jan. 13, 2012 From the Australian Government, IP Australia Re. Application No. 2011239323.

Response Dated Dec. 22, 2011 to Official Action of Aug. 22, 2011 From the US Patent and Trademark Office Re. U.S. Appl. No. 12/457,199.

Supplementary European Search Report and the European Search Opinion Dated Jan. 2, 2012 From the European Patent Office Re. Application No. 09807983.3.

Translation of Decision of Rejection Dated Dec. 9, 2011 From the State Intellectual Property Office of the People's Republic of China Re.: Application No. 200580027481.4.

Adachi et al. "*Oryza sativa* Japonica Group cDNA Clone:J023021L06, Full Insert Sequence", Database EMBASE [Online], XP002665608, Retrieved From EBI, Database Accession No. AK099270, Jul. 19, 2003.

Feng et al. "Probable Cinnamyl Alcohol Dehydrogenase 6", Darabase UniProt [Online], XP002665609, Retrieved From EBI, Database Accession No. Q7XWU3, Mar. 1, 2004.

Bichinho et al. "A Computer Tool for the Fusion and Visualization of Thermal and Magnetic Resonance Images", Journal of Digital Imaging, XP002527797, 22(5): 527-534, Oct. 2009. p. 3, col. 1, Line 5—col. 2, Line 6, Fig. 1.

Deng et al. "Enhacement of Thermal Diagnostics on Tumors Underneath the Skin by Induced Evaporation", Proceedings of the 2005 27th Annual International Conference of the Engineering in Medicine and Biology Society, Shanghai, China, Sep. 1-4, 2005, IEEE-EMBS 2005, XP002519610, 7: 7525-7528, 2005. Passage Bridging p. 7526 and p. 7527, Abstract, Figs.4, 5.

Lipari et al "Advanced Infrared Image Processing for Breast Cancer Risk Assessment", Proceedings of the 19th Annual International Conference of the IEEE/EMBS Engineering in Medicine and Biology Society, Chicago, IL, USA, Oct. 30-Nov. 2, 1997, XP010325780, 2: 673-676, Oct. 30, 1997. Abstract, Sections II, III, Fig.3.

Moderhak et al. "Problems of 3D Breast Imaging", Gdansk University of Technology, Department of Biomedical Engineering, 2 P.

Tan et al. "A Novel Cognitive Interpretation of Breast Cancer Thermography With Complementary Learning Fuzzy Neural Memory Structure", Expert Systems With Applications, XP005919120, 33(3): 652-666, Mar. 13, 2007. Abstract, p. 658-659, Section 4, Fig.5.

Examiner's Report Dated Jan. 13, 2011 From the Australian Patent Office Re.: Application No. 2005252469.

Response Dated Jan. 19, 2011 to Supplementary European Search Report and the European Search Opinion of Jul. 1, 2010 From the European Patent Office Re. Application No. 07849616.3.

Blewitt et al. "*Gossypium hirsutum* Strain Acala Maxxa BURP Domain-Containing Protein (BNL1924) mRNA, Complete CDS", GenBank Nucleotide, GenBank Accession No. AY343972, Aug. 16, 2003.

Li et al. "Isolation of Genes Preferntially Expressed in Cotton Fibers by cDNA Filter Arrays and RT-PCR", Plant Science, 163: 1113-1120, 2002. & GenBank Nucleotide "*Gossypium hirstutum* Dehydration-Iduced Protein RD22-Like Protein (RDL0 mRNA, Complete CDS", GenBank Accession No. AY072821, Dec. 4, 2002.

International Preliminary Report on Patentability Dated Feb. 21, 2013 From the International Bureau of WIPO Re. Application No. PCT/IB2011/051843.

Official Action Dated Feb. 8, 2013 From the US Patent and Trademark Office Re. U.S. Appl. No. 12/594,853.

Supplementary European Search Report and the European Search Opinion Dated Feb. 14, 2013 From the European Patent Office Re. Application No. 10785834.2.

Examination Report Dated Jun. 11, 2012 From the Instituto Mexicano de la Propiedad Industrial Re. Application No. MX/a/2011/007294 and Summary in English.

Office Action Dated Feb. 3, 2011 From the Israel Patent Office Re.: Application No. 172135 and Its Translation Into English.

(56) References Cited

OTHER PUBLICATIONS

Official Action Dated Feb. 15, 2011 From the US Patent and Trademark Office Re. U.S. Appl. No. 12/448,359.
International Preliminary Report on Patentability Dated Mar. 3, 2011 From the International Bureau of WIPO Re.: Application No. PCT/IB2009/053633.
International Search Report and the Written Opinion Dated Jun. 2, 2010 From the International Searching Authority Re. Application No. PCT/IB09/53633.
Invitation to Pay Additional Fees Dated Mar. 2, 2010 From the International Searching Authority Re.: Application No. PCT/IB09/53633.
Restriction Official Action Dated Mar. 1, 2013 From the US Patent and Trademark Office Re. U.S. Appl. No. 13/254,183.
Response Dated Feb. 9, 2011 to Communication Pursuant to Article 94(3) EPC of Nov. 19, 2010 From the European Patent Office Re.: Application No. 06809784.9.
Examiner's Report Dated Mar. 15, 2012 From the Australian Government, IP Australia Re. Application No. 2011239323.
International Preliminary Report on Patentability Dated Mar. 14, 2013 From the International Bureau of WIPO Re. Application No. PCT/IB2011/053697.
Communciation Pursuant to Rules 70(2) and 70a(2) EPC Dated Aug. 30, 2011 From the European Patent Office Re. Application No. 08738191.9.
Response Dated Feb. 23, 2011 to Communication Pursuant to Rule 70(2) EPC and Reference to Rule 39(1) EPC of Sep. 13, 2010 From the European Patent Office Re.: Application No. 09163033.5.
Response Dated Feb. 24, 2011 to Communciation Pursuant to Rules 70(2) and 70a(2) EPC of Aug. 30, 2011 From the European Patent Office Re. Application NO. 08738191.9.
International Search Report and the Written Opinion Dated Apr. 10, 2013 From the International Searching Authority Re. Application No. PCT/IL2012/050327.
Invitation to Pay Additional Fees Dated Apr. 8, 2013 From the International Searching Authority Re. Application No. PCT/IL2013/050172.
Requisition by the Examiner Dated Apr. 11, 2013 From the Canadian Intellectual Property Office Re. Application No. 2,626,592.
Translation of Office Action Dated Mar. 22, 2013 From the State Intellectual Property Office of the People's Republic of China Re. Application No. 200880109464.9.
Soderlund et al. "Sequencing, Mapping, and Analysis of 27,455 Maize Full-Length cDNAs", PLoS Genetics, 5(11): e1000740-1-e1000740-13, Nov. 2009.
Official Action Dated Apr. 10, 2012 From the US Patent and Trademark Office Re. U.S. Appl. No. 12/669,975.
Response Dated Mar. 8, 2011 to Examiner's Report of Jan. 13, 2011 From the Australian Government, IP Australia Re.: Application No. 2005252469.
Response Dated Mar. 9, 2011 to Office Action of Nov. 11, 2010 From the Israel Patent Office Re. Application No. 206118.
Response Dated Mar. 23, 2011 to Official Action of Nov. 23, 2010 From the US Patent and Trademark Office Re. U.S. Appl. No. 12/083,978.
Response Dated Mar. 24, 2011 to Examination Report of Nov. 3, 2010 From the Government of India, Patent Office Re.: Application No. 158/CHENP/2007.
Examination Report Dated Dec. 7, 2012 From the Instituto Mexicano de la Propiedad Industrial Re. Application No. MX/a/2011/003575 and Its Translation Into English.
Patent Examination Report Dated Jan. 4, 2013 From the Australian Government, IP Australia Re. Application No. 2008344935.
Official Action Dated May 14, 2012 From the US Patent and Trademark Office Re. U.S. Appl. No. 12/457,199.
Examiner's Report Dated Dec. 20, 2011 From the Australian Government, IP Australia Re. Application No. 2005234725.
Examiner's Report Dated Jun. 24, 2011 From the Australian Government, IP Australia Re. Application No. 2006281018.
Examiner's Report Dated Jun. 30, 2011 From the Australian Government, IP Australia Re. Application No. 2006307457.
Office Action Dated Jun. 19, 2011 From the Israel Patent Office Re. Application No. 199391 and Its Translation Into English.
Response Dated Jun. 9, 2011 to Examiner's Report of Dec. 20, 2011 From the Australian Government, IP Australia Re. Application No. 2005234725.
Communication Pursuant to Article 94(3) EPC Dated Jul. 4, 2012 From the European Patent Office Re. Application No. 10194223.3.
Examination Report Dated Jun. 6, 2012 From the Federal Service of Intellectual Property, Federal State Budget Institute, Federal Institute of Industrial Property of the Russian Federation Re. Application No. 2011113420 and Its Translation Into English.
Supplementary European Search Report and the European Search Opinion Dated Jul. 6, 2012 From the European Patent Office Re. Application No. 10748403.2.
Ishikawa et al. JP 2005-185101: Full Length cDNA of Plant and the Use Thereof, Database EMBL [Online], XP002678022, Retrieved From EBI Accession No. EM_PAT:IIV067703, Database Assession No. IIV067703, Jul. 15, 2011. Sequence.
Kikuchi et al. "Rice cDNA-Encoded Protein SEQ ID No. 31047", Database Geneseq [Online ], XP002678021, Retrieved From EBI Accession No. GSP:AQD37188, Database Accession No. AGD37188, Jun. 12, 2008. Shows 100% Identity to Present SEG ID NO:246 (Protein) and Corresponding Polynucleotide Shows 100% Identity to SEQ ID NO:7 Over 458 Nucleotides. Abstract.
La Rosa et al. "*Oryza sativa* Amino Acid Sequence SEQ ID NO 133688", Database Geneseq [Online], XP002678023, Retrieved From EBI Accession No. GSP:ANM19687, Database Accession No. ANM19687, Dec. 28, 2007. 100% Identity to Present SEQ IFD NO:246, Corresponding Polynucleotide Has 99,6% Identity to Present SEQ ID NO:7 Over 488 Nucleotides. Abstract, Sequence.
La Rosa et al. "*Oryza sativa* Nucleotide Sequence SEQ ID NO 31205", Database Geneseq [Online], XO002678024, Retrieved From EBI Accession No. GSN:ANL17203, Database Accession No. ANL17203, Dec. 28, 2007. Sequence.
European Search Report and the European Search Opinion Dated Jun. 14, 2011 From the European Patent Office Re. Application No. 11154193.4.
European Search Report and the European Search Opinion Dated Jun. 21, 2011 From the European Patent Office Re. Application No. 11154213.0.
Office Action Dated Jun. 20, 2011 From the Israel Patent Office Re. Application No. 190918 and Its Translation Into English.
Partial European Search Report Dated Jul. 12, 2011 From the European Patent Office Re. Application No. 10194223.3.
Response Dated Jun. 15, 2011 to Examiner's Report of Mar. 31, 2011 From the Australian Government, IP Australia Re.: Application No. 2005252469.
Li et al. "*Gossypium hirsutum* Dehydration-Induced Protein RD22-Like Protein (RDL) mRNA, Complete CDS", EBI Accession No. EMBL:AY072821, XP002639385, Database Accession No. AY072821, Dec. 4, 2002. Compound.
Purnelle et al. "*Arabidopsis thaliana* DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.
Wing et al. "GA_Eb0026P18f *Gossypium arboreum* 7-10 Dpa Fiber Library *Gossypium arboreum* cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.
Yamada et al. "*Arabidopsis thaliana* Unknown Proein (At3g51610) mRNA, Complete CDS", Database EMBL [Online], XP002640828, Retrieved Fom EBI Accession No. EMBL:AY034915, Database Accession No. AY034915, Jun. 13, 2001. Compound.
Translation of Office Action Dated Apr. 9, 2012 From the State Intellectual Property Office of the People's Republic of China Re. Application No. 200880017707.6.
International Search Report and the Written Opinion Dated Aug. 6, 2012 From the International Searching Authority Re. Application No. PCT/IB11/53697.

(56) References Cited

OTHER PUBLICATIONS

Daniell et al. "*Solanum bulbocastanum* Chloroplast, Complete Genome", GenBank NCBI, Accession No. NC_007943, Mar. 26, 2010. p. 1, Source, p. 10-11, Nucleotides 46590-47195, Gene 'RPS4'.
International Preliminary Report on Patentability Dated Oct. 7, 2010 From the International Bureau of WIPO Re. Application No. PCT/1L2008/001684.
Agostini et al. "Evaluation of Feature-Based Registration in Dynamic Infrared Imaging for Breast Cancer Diagnosis", Proceedings of the 28th IEEE EMBS (Engineering in Medicine and Biology) Annual International Conference, New York City, USA, Aug. 30-Sep. 3, 2006, XP031235634, p. 953-956, Aug. 30, 2006. p. 953, § 2, 3.
Aksenov et al. "3D Thermography for Quantification of Heat Generation Resulting From Inflammation", Proceedings of the 8th 3D Modelling Symposium, Paris, France, XP))2523191, 11 P., 2003.
Bichinho et al. "A Computer Tool for the Fusion and Visualization of Thermal and Magnetic Resonance Images", Journal of Digital Imaging, XP002527797, 22(5): 527-534, Oct. 2009. p. 3, col. 1, Line 5—col. 2, Line 6, Fig.1.
Bernhardt et al. "The bHLH Genes GLABRA3 (GL3) and Enhancer of GLABRA3 (EGL3) Specify Epidermal Cell Fate in the *Arabidopsis* Root", Development, 130(26): 6431-6439, 2003.
Payne et al. "GL3 Encodes a bHLh Protein That Regulates Trichome Development in *Arabidopsis* Through Interaction With GL1 and TTG1", Genetics, 156: 1349-1362, Nov. 2000.
International Search Report and the Written Opinion Dated Dec. 6, 2011 From the International Searching Authority Re. Application No. PCT/IB2011/051843.
Notice of Allowance Dated Dec. 5, 2011 From the US Patent and Trademark Office Re. U.S. Appl. No. 12/448,359.
Response Dated Dec. 15, 2011 to Examiner's Report of Aug. 1, 2011 From the Australian Government, IP Australia Re. Application No. 2005234725.
Communication Pursuant to Rules 70(2) and 70a(2) EPC Dated May 24, 2011 From the European Patent Office Re. Application No. 09750276.9.
Examination Report Dated Apr. 19, 2011 From the Instituto Mexican de la Propriedad Industrial Re. Application No. MX/a/2008/002262 and Its Summary Into English.
Communication Under Rule 71(3) EPC Dated Jun. 5, 2012 From the European Patent Office Re.: Application No. 06809784.9.
Official Action Dated Jun. 19, 2012 From the US Patent and Trademark Office Re. U.S. Appl. No. 13/450,547.
Communication Pursuant to Article 94(3) EPC Dated Jun. 29, 2011 From the European Patent Office Re. Application No. 08738191.9.
Response Dated Jun. 2, 2011 to Office Action of Feb. 3, 2011 From the Israel Patent Office Re.: Application No. 172135.
Communication Pursuant to Article 94(3) EPC Dated Oct. 23, 2012 From the European Patent Office Re. Application No. 11154213.0.
Examination Report Dated Oct. 15, 2012 From the Instituto Mexicano de la Propiedad Industrial Re. Application No. MX/a/2009/006660 and Its Translation Into English.
Notice of Allowance Dated Nov. 19, 2012 From the US Patent and Trademark Office Re. U.S. Appl. No. 13/450,547.
International Preliminary Report on Patentability Dated Dec. 1, 2011 From the International Bureau of WIPO Re. Application No. PCT/IL2008/000489.
Lin et al. "*Arabidopsis thaliana* Chromosome III BAC F7O18 Genomic Sequence, Complete Sequence", GenBank Accession No. AC011437, Oct. 30, 2002.
Patent Examination Report Dated Dec. 12, 2012 From the Australian Government, IP Australia Re. Application No. 2008236316.
Communication Pursuant to Article 94(3) EPC Dated Nov. 8, 2010 From the European Patent Office Re.: Application No. 04734072.4.
Communication Pursuant to Article 94(3) EPC Dated Nov. 19, 2010 From the European Patent Office Re.: Application No. 06809784.9.
Communication Pursuant to Article 94(3) EPC Dated Dec. 19, 2012 From the European Patent Office Re.: Application No. 04734072.4.
Official Action Dated Dec. 18, 2012 From the US Patent and Trademark Office Re. U.S. Appl. No. 12/834,106.
Benfey et al. "The CaMV 35S Enhancer Contains at Least Two Domains Which Can Confer Different Development and Tissue-Specific Expression Patterns", The EMBO Journal, 8(8): 2195-2202, 1989.
Benfey et al. "The Cauliflower Mosaic Virus 35S Promoter: Combinatorial Regulation of Transcription in Plants", Science, 250(4983): 959-966, Nov. 16, 1990.
Response Dated Dec. 19, 2011 to Examiner's Report of Oct. 19, 2011 From the Australian Government, IP Australia Re. Application No. 2006281018.
Response Dated Jun. 29, 2011 to Communication Pursuant to Article 94(3) EPC of Mar. 8, 2011 From the European Patent Office Re.: Application No. 06809784.9.
Decision on Granting a Patent for Invention Dated Dec. 7, 2010 From the ROSPATENT, Federal State Institution, Federal Institute for Industrial Property of the Federal Service for Intellectual Property, Patents and Trademarks of the Russian Federation Re. Application No. 2008120395 and Its Translation Into English.
Notice of Allowance Dated Jan. 7, 2013 From the US Patent and Trademark Office Re. U.S. Appl. No. 12/457,199.
Official Action Dated Jan. 18, 2013 From the US Patent and Trademark Office Re. U.S. Appl. No. 12/669,975.
Notice of Grant Dated Jan. 14, 2011 From the Instituto Mexicano de la Propiedad Industrial Re. Application No. MX/a/2008/005280.
Restriction Official Action Dated Feb. 1, 2012 From the US Patent and Trademark Office Re. U.S. Appl. No. 12/669,975.
International Search Report and the Written Opinion Dated Aug. 22, 2011 From the International Searching Authority Re: Application No. PCT/IB2010/56023.
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Examination Report Dated Dec. 19, 2011 From the Federal Service of Intellectual Property, Federal State Budget Institute, Federal Institute of Industrial Property of the Russian Federation Re. Application No. 2011113420 and Its Translation Into English.
Examiner's Report Dated Jan. 31, 2012 From the Australian Government, IP Australia Re. Application No. 2006281018.
Office Action Dated Jan. 2, 2012 From the Israel Patent Office Re. Application No. 206118 and Its Translation Into English.
Restriction Official Action Dated Feb. 13, 2012 From the US Patent and Trademark Office Re. U.S. Appl. No. 12/594,853.
Invitrogen "SuperScript® Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
Translation of Office Action Dated Jan. 4, 2012 From the State Intellectual Property Office of the People's Republic of China Re. Application No. 200880109464.9.
Translation of Office Action Dated Jan. 17, 2012 From the State Intellectual Property Office of the People's Republic of China Re. Application No. 201110104274.1.
Translation of Office Action Dated Dec. 31, 2011 From the State Intellectual Property Office of the People's Republic of China Re. Application No. 200910217137.1.
Translation of Office Action Dated Feb. 25, 2013 From the State Intellectual Property Office of the People's Republic of China Re. Application No. 200910217137.1.
Notice of Allowance Dated Apr. 8, 2013 From the US Patent and Trademark Office Re. U.S. Appl. No. 12/594,853.
Requisition by the Examiner Dated Mar. 25, 2013 From the Canadian Intellectual Property Office Re. Application No. 2,619,114.
Communication Pursuant to Rule 55 EPC Dated Mar. 16, 2012 From the European Patent Office Re. Application No. 11190921.4.

(56) References Cited

OTHER PUBLICATIONS

Restriction Official Action Dated Apr. 11, 2012 From the US Patent andTrademark Office Re. U.S. Appl. No. 12/834,106.
Examiner's Report Dated Mar. 31, 2011 From the Australian Government, IP Australia Re.: Application No. 2005252469.
Communication Pursuant to Article 94(3) EPC Dated Apr. 3, 2012 From the European Patent Office Re.: Application No. 06766224.7.
Examination Report Dated Jun. 11, 2012 From the Instituto Mexicano de la Propiedad Industrial Re. Application No. MX/a/2011/007294 and Its Translation Into English.
Official Action Dated Jul. 17, 2012 From the US Patent and Trademark Office Re. U.S. Appl. No. 12/834,106.
Kano-Murakami et al. "A Rice Homeotic Gene, OSH1, Causes Unusual Phenotypes in Transgenic Tobacco", FEBS Letters, 334(3): 365-368, Nov. 1993.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 18, 2011 From the European Patent Office Re. Application No. 11154193.4.
Communication Pursuant to Rule 69 EPC—Reminder Concerning Payment of the Designation Fee (Art. 94(2) EPC) and of the Examination Fee (Art. 94(1) EPC)—and Invitation Pursuant to Rule 70a(1) EPC Dated Jul. 25, 2011 From the European Patent Office Re. Application No. 11154213.0.
Examiner's Report Dated Jul. 21, 2011 From the Australian Government, IP Australia Re. Application No. 2005234725.
Response Dated Jul. 3, 2011 to Examination Report of Apr. 19, 2011 From the Instituto Mexicano de la Propiedad Industrial Re. Application No. MX/a/2008/002262 and its Summary Into English.
Response Dated Jun. 6, 2011 to Official Action of May 10, 2011 From the US Patent and Trademark Office Re. U.S. Appl. No. 12/457,199.
Response Dated Jul. 25, 2011 to Examiner's Report of Jul. 21, 2011 From the Australian Government, IP Australia Re. Application No. 2005234725.
Response Dated Aug. 11, 2011 to Examination Report of Aug. 1, 2011 From the Government of India, Patent Office Re.: Application No. 158/CHENP/2007.
Translation of Office Action Dated Jul. 1, 2011 From the State Intellectual Property Office of the People's Republic of China Re. Application No. 200880017707.6.
Yanagisawa et al. "Metabolic Engineering With Dof1 Transcription Factor in Plants: Improved Nitrogen Assimilation and Growth Under Low-Nitrogen Conditions", Proc. Natl. Acad. Sci. USA, PNAS, 101(20): 7833-7838, May 18, 2004.
Advisory Action Before the Filing of an Appeal Brief Dated Aug. 5, 2011 From the US Patent and Trademark Office Re. U.S. Appl. No. 12/083,978.
Invitation to Pay Additional Fees Dated Aug. 18, 2011 From the International Searching Authority Re.: Application No. PCT/IL08/00489.
Katavic et al. "Utility of the *Arabidopsis* FAE1 and Yeast SLC1-1 Genes for Improvement in Erucic Acid and Oil Content in Rapeseed", Biochemical Society Transaction, 28(6): 935-937, Dec. 2000.
Gaxiola et al. "Drought- and Salt-Tolerant Plants Result From Overexpression of the AVP1 H+ -Pump", Proc. Natl. Acad. Sci. USA, PNAS, 98(20): 11444-11449, Sep. 25, 2001.
Quesada et al. "Genetic Architecture of NaCl Tolerance in *Arabidopsis*", Plant Physiology, 130: 951-963, 2002. Abstract!
Vigeolas et al. "Increasing Seed Oil Content in Oil-Seed Rape (*Brassica napus* L.) by Over-Expression of a Yeast Glycerol-3-Phosphate Dehydrogenase Under the Control of a Seed-Specific Promoter", Plant Biotechnology Journal, 5 Issue: 431-441, 2007. Abstract!
International Preliminary Report on Patentability Dated Sep. 15, 2011 From the International Bureau of WIPO Re. Application No. PCT/IB2010/050871.
Official Action Dated Aug. 22, 2011 From the US Patent and Trademark Office Re. U.S. Appl. No. 12/457,199.
Johansson et al. "The Role of Aquaporins in Cellular and Whole Plant Water Balance," Biochimica et Biophysica Acta 1465: 324-342, 2000.
Whisstock et al. "Prediction of Protein Function from Protein Sequence and Structure," Quarterly Reviews of Biophysics 36 (3): 307-340, Aug. 2003.
Official Action Dated Sep. 19, 2011 From the US Patent and Trademark Office Re. U.S. Appl. No. 12/810,855.
Response Dated Sep. 25, 2011 to Examiner's Report of Jun. 30, 2011 From the Australian Government, IP Australia Re. Application No. 2006307457.
Response Dated Oct. 3, 2011 to Examiner's Report of Jun. 24, 2011 From the Australian Government, IP Australia Re. Application No. 2006281018.
Response Dated Oct. 4, 2011 to Official Action of Jul. 8, 2011 From the US Patent and Trademark Office Re. U.S. Appl. No. 12/083,978.
Restriction Official Action Dated Nov. 13, 2012 From the US Patent and Trademark Office Re. U.S. Appl. No. 12/992,902.
Response Dated Oct. 18, 2011 to Official Action of Sep. 19, 2011 From the US Patent and Trademark Office Re. U.S. Appl. No. 12/810,855.
Communication Under Rule 71(3) EPC Dated Nov. 19, 2012 From the European Patent Office Re. Application No. 08738191.9.
Translation of Notification of the Office Action Dated Dec. 1, 2011 From the State Intellectual Property Office of the People's Republic of China Re. Application No. 200680047610.0.
Communication Pursuant to Article 94(3) EPC Dated Jan. 3, 2013 From the European Patent Office Re. Application No. 09807983.3.
English Summary of Examination Results Dated Dec. 28, 2012 From the National Office of Intellectual Property (NOIP) of Vietnam Re. Application No. 1-2009-02358.
International Search Report and the Written Opinion Dated Jan. 7, 2013 From the International Searching Authority Re. Application No. PCT/IL2012/050154.
Invitation to Pay Additional Fees Dated Dec. 31, 2012 From the International Searching Authority Re. Application No. PCT/IL2012/050327.
Communication Pursuant to Article 94(3) EPC Dated Feb. 14, 2012 From the European Patent Office Re.: Application No. 04734072.4.
Requisition by the Examiner Dated Feb. 2, 2012 From the Canadian Intellectual Property Office Re. Application No. 2,570,195.
Communication Pursuant to Article 94(3) EPC Dated Mar. 8, 2011 From the European Patent Office Re.: Application No. 06809784.9.
Communication Pursuant to Article 94(3) EPC Dated Mar. 14, 2011 From the European Patent Office Re. Application No. 07849616.3.
Response Dated Feb. 14, 2011 to Supplementary European Search Report and the European Search Opinion of Jul. 29, 2010 From the European Patent Office Re. Application No. 08776651.5.
Response Dated Mar. 14, 2011 to Official Action of Feb. 15, 2011 From the US Patent and Trademark Office Re. U.S. Appl. No. 12/448,359.
Restriction Official Action Dated Apr. 4, 2013 From the US Patent and Trademark Office Re. U.S. Appl. No. 13/125,047.
Official Action Dated May 10, 2011 From the US Patent and Trademark Office Re. U.S. Appl. No. 12/457,199.
Official Action Dated Apr. 29, 2011 From the US Patent and Trademark Office Re. U.S. Appl. No. 12/448,359.
Response Dated Apr. 21, 2011 to Communication Pursuant to Article 94(3) EPC of Nov. 8, 2010 From the European Patent Office Re.: Application No. 04734072.4.
Supplementary European Search Report and the European Search Opinion Dated May 6, 2011 From the European Patent Office Re. Application No. 09750276.9.
Payne et al. "Heterologous MYB Genes Distinct From GL1 Enhance Trichome Production When Overexpressed in *Nicotiana tabacum*", Development, 126: 671-682, 1999.
Sunkar et al. "Small RNAs as Big Players in Plant Abiotic Stress Responses and Nutrient Deprivation", Trends in Plant Science XP022148764, 12(7): 301-309, Jul. 1, 2007.
Requisition by the Examiner Dated Jun. 15, 2011 From the Canadian Intellectual Property Office Re. Application No. 2,526,440.
Communication Pursuant to Article 94(3) EPC Dated Jul. 13, 2012 From the European Patent Office Re. Application No. 11172514.9.

(56) References Cited

OTHER PUBLICATIONS

Official Action Dated Jul. 8, 2011 From the US Patent and Trademark Office Re. U.S. Appl. No. 12/083,978.
Response Dated Jun. 17, 2011 to Examiner's Report of Mar. 31, 2011 From the Australian Government, IP Australia Re.: Application No. 2005252469.
Examination Report Dated Aug. 1, 2011 From the Government of India, Patent Office Re.: Application No. 158/CHENP/2007.
Examination Report Dated May 25, 2011 From the Government of India, Patent Office Re.: Application No. 158/CHENP/2007.
Examiner's Report Dated Aug. 1, 2011 From the Australian Government, IP Australia Re. Application No. 2005234725.
Response Dated Jul. 6, 2011 to Examiner's Report of Dec. 20, 2010 From the Australian Government, IP Australia Re. Application No. 2005234725.
Response Dated Jul. 20, 2011 to Examination Report of May 25, 2011 From the Government of India, Patent Office Re.: Application No. 158/CHENP/2007.
Translation of Notification of the First Office Action Dated Jun. 30, 2011 From the State Intellectual Property Office of the People's Republic of China Re. Application No. 200680047610.0.
Van der Hoeven et al. "EST312975 Tomato Root During/After Fruit Set, Cornell University *Solanum lycopersicum* cDNA Clone cLEX14O20 5-, mRNA Sequence", GenBank, GenBank Accession No. AW622177.1.
Applicant-Initiated Interview Summary Dated Aug. 6, 2012 From the US Patent and Trademark Office Re. U.S. Appl. No. 12/669,975.
Communication Pursuant to Rules 70(2) and 70a(2) EPC Dated Jul. 24, 2012 From the European Patent Office Re. Application No. 10748403.2.
International Preliminary Report on Patentability Dated Jul. 12, 2012 From the International Bureau of WIPO Re. Application No. PCT/IB2010/056023.
Office Action Dated Jun. 25, 2012 From the State Intellectual Property Office of the People's Republic of China Re.: Application No. 200880109464.9 and Its Translation Into English.
Advisory Action Before the Filing of an Appeal Brief Dated Aug. 29, 2012 From the US Patent and Trademark Office Re. U.S. Appl. No. 12/457,199.
Examination Report Dated Aug. 16, 2012 From the Instituto Mexicano de la Propiedad Industrial Re. Application No. MX/a/2010/014097 and Its Translation Into English.
Communication Pursuant to Rules 70(2) and 70a(2) EPC Dated May 7, 2012 From the European Patent Office Re. Application No. 09823171.5.
Examination Report Dated Sep. 14, 2012 From the Australian Government IP Australia Re. Application No. 2007335706.
Examination Report Dated Jun. 25, 2012 From the Instituto Mexicano de la Propiedad Industrial Re. Application No. MX/a/2011/003575 and Its Translation Into English.
International Preliminary Report on Patentability Dated Apr. 12, 2012 From the Interantional Bureau of WIPO Re. Application No. PCT/IB2010/052545.
International Preliminary Report on Patentability Dated May 12, 2011 From the International Bureau of WIPO Re. Application No. PCT/IB2009/054774.
International Search Report and the Written Opinion Dated Jun. 2, 2010 From the International Searching Authority Re.: Application No. PCT/IB09/54774.
International Search Report and the Written Opinion Dated Sep. 6, 2012 From the International Searching Authority Re. Application No. PCT/IB2011/055854.
International Search Report and the Written Opinion Dated Mar. 16, 2012 From the International Searching Authority Re. Application No. PCT/IB2010/052545.
Invitation to Pay Additional Fees Dated Jun. 15, 2012 From the International Searching Authority Re. Application No. PCT/IB2011/055854.
Invitation to Pay Additional Fees Dated Dec. 27, 2011 From the International Searching Authority Re. Application No. PCT/IB2010/052545.
Supplementary European Search Report and the European Search Opinion Dated Apr. 18, 2012 From the European Patent Office Re. Application No. 09823171.5.
Translation of Examination Report Dated Sep. 6, 2010 From the Government of the People's Republic of Bangladesh, Department of Patents, Designs and Trademarks, Ministry of Industries Re. Application No. 275/2009.
Bautista et al. "*Arabidopsis thaliana* At5g06690 mRNA, Complete Cds", Unpublished, The Salk Institute for Biological Studies, La Jolla, CA, USA, GenBank: BT029447, Nov. 15, 2006.
Castelli et al. "*Arabidopsis thaliana* Full-Length cDNA Complete Sequence From Clone GSLTFB52ZA10 of Flowers and Buds of Strain Col-0 of *Arabidopsis thaliana* (Thale Cress)", GeneBank Direct Submission BX829993, Accession No. BX829993, Feb. 6, 2004.
Cheuk et al. "*Arabidopsis thaliana* At2g40550 Gene, Complete CDS", Database EMBL [Online], XP002673499, Retrieved From EBI Accession No. EM PL: BT022032.1, Database Accession No. BT022032, May 4, 2005.
Matsumoto et al. "*Hordeum vulgare* Subsp. *Vulgare*, Full-Length cDNA", UniProtKB/TrEMBL, ID: F2DLE8-HORVD, UniProt Accession No. F2DLE8, May 31, 2011.
Rounsley et al. "*Arabidopsis thaliana* Chromosome 2 Clone T2P4 Map CIC10A06, Complete Sequence", Database EMBL [Online], XP002673500, Retrieved From EBI Accession No. EMBL:AC002336, Database Accession No. AC002336, Jul. 18, 1997. Sequence.
Takahashi et al. "The DNA Replication Checkpoint Aids Survival of Plants Deficient in the Novel Replisome Factor ETG1", The EMBO Journal, XP002537888, 27(13): 1840-1851, Jul. 9, 2008 & Supplementary Materials and Methods. Suppl. Fig. S6, p. 1844-1845.
Translation of Office Action Dated Sep. 13, 2012 From the State Intellectual Property Office of the People's Republic of China Re. Application No. 200910217137.1.
Office Action Dated Sep. 22, 2011 From the Israeli Patent Office Re. Application No. 201242 and Its Translation Into English.
Response Dated Oct. 17, 2011 to Requisition by the Examiner of Jun. 15, 2011 From the Canadian Intellectual Property Office Re. Application No. 2,526,440.
Chames et al. "Direct Selection of a Human Antibody Fragment Directed Against the Tumor T-Cell Epitope HLA-A1-MAGE-A1 From a Nonimmunized Phage-Fab Library", Proc. Natl. Acad. Sci. USA, PNAS, XP002967292, 97(14): 7969-7974, Jul. 5, 2000.
Invitation to Pay Additional Fees Dated Oct. 17, 2012 From the International Searching Authority Re. Application No. PCT/IL2012/050154.
Communication Pursuant to Article 94(3) EPC Dated Oct. 23, 2012 From the European Patent Office Re. Application No. 11154193.4.
Requisition by the Examiner Dated Oct. 3, 2012 From the Canadian Intellectual Property Office Re. Application No. 2,526,440.
Translation of Notice of Paying Restoration Fee for Unity of Invention Dated Oct. 29, 2012 From the State Intellectual Property Office of the People's Republic of China Re. Application No. 200880127757.X.
Alcala et al. "EST543159 Tomato Callus *Solanum lycopersicum* cDNA Clone cLEC80A19 5-end, mRNA Sequence", GenBank: BI923254.1, GenDank Accession No. BI923254, Oct. 17, 2001.
European Search Report and the European Search Opinion Dated Nov. 2, 2011 From the European Patent Office Re. Application No. 10194223.3.
Examiner's Report Dated Oct. 19, 2011 From the Australian Government, IP Australia Re. Application No. 2006281018.
Examiner's Report Dated Oct. 28, 2011 From the Australian Government, IP Australia Re. Application No. 2006307457.
International Search Report and the Written Opinion Dated Oct. 31, 2011 From the International Searching Authority Re.: Application No. PCT/IL08/00489.
Response Dated Oct. 19, 2011 to Official Action of Apr. 29, 2011 From the US Patent and Trademark Office Re. U.S. Appl. No. 12/448,359.

(56) References Cited

OTHER PUBLICATIONS

Response Dated Oct. 27, 2011 to Communication Pursuant to Article 94(3) EPC of Jun. 29, 2011 From the European Patent Office Re. Application No. 08738191.9.
Response Dated Oct. 27, 2011 to Office Action of Jul. 1, 2011 From the State Intellectual Property Office of the People's Republic of China Re. Application No. 200880017707.6.
Response Dated Oct. 27, 2011 to Supplementary European Search Report and the European Search Opinion of May 6, 2011 From the European Patent Office Re. Application No. 09750276.9.
Response Dated Oct. 31, 2011 to Notification of the First Office Action of Jun. 30, 2011 From the State Intellectual Property Office of the People's Republic of China Re. Application No. 200680047610.0.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.
Communication Pursuant to Article 94(3) EPC Dated May 29, 2013 From the European Patent Office Re. Application No. 09823171.5.
Patent Examination Report Dated Jun. 21, 2013 From the Australian Government, IP Australia Re. Application No. 2012241091.
Kikuchi et al. "*Oryza sativa* Japonica Group cDNA Clone: J023131O04, Full Insert Sequence", GenBank Database Accession No. AK072531, Jul. 2, 2013.
Office Action Dated Oct. 28, 2013 From the State Intellectual Property Office of the People's Republic of China Re. Application No. 201110104274.1 and Its Translation Into English.
Requisition by the Examiner Dated Aug. 27, 2013 From the Canadian Intellectual Property Office Re. Application No. 2,526,440.
Notice of Allowance Dated Nov. 15, 2013 From the US Patent and Trademark Office Re. U.S. Appl. No. 12/669,975.
Patent Examination Report Dated Jun. 27, 2013 From the Australian Government, IP Australia Re. Application No. 2012216482.
Matz et al. "*Gossypium hirsutum* GHDEL65 (ghdel65) mRNA, Complete CDS", GenBank Nucleotide, GenBank Accession No. AF336280, Mar. 15, 2001.
Official Action Dated Jul. 26, 2013 From the US Patent and Trademark Office Re. U.S. Appl. No. 13/254,183.
Matsumoto et al. "Os11g0162200 [*Oryza sativa* Japonica Group]", Direct GenBank Sequence Submission, GenBank: BAF27672.1, GenBank Accession No. BAF27672, Aug. 11, 2012.
Communication Pursuant to Article 94(3) EPC Dated Aug. 2, 2013 From the European Patent Office Re. Application No. 10194223.3.
Examination Report Dated Jul. 9, 2013 From the Instituto Mexicano de la Propiedad Industrial Re. Application No. MX/a/2010/007169 and Its Translation Into English.
Examination Report Dated Jun. 26, 2013 From the Instituto Mexicano de la Propiedad Industrial Re. Application No. MX/a/2010/000975 and Its Translation Into English.
Official Action Dated Aug. 12, 2013 From the US Patent and Trademark Office Re. U.S. Appl. No. 12/834,106.
Substantive Examination Report Dated Jul. 31, 2013 From the Intellectual Property Office of the Philippines, Bureau of Patents Re. Application No. 1/2009/501930.
Examination Report Dated May 23, 2013 From the Instituto Mexican de la Propiedad Industrial Re. Application No. MX/a/2011/001741 and Its Translation Into English.
Invitation to Pay Additional Fees Dated Jul. 17, 2013 From the International Searching Authority Re. Application No. PCT/IB2013/054374.
Communication Pursuant to Article 94(3) EPC Dated Nov. 7, 2013 From the European Patent Office Re. Application No. 10748403.2.
Communication Pursuant to Rules 70(2) and 70a(2) EPC Dated Nov. 4, 2013 From the European Patent Office Re. Application No. 10840687.7.
Examination Report Dated Aug. 22, 2013 From the Instituto Mexicano de la Propicdad Industrial Re. Application No. MX/a/2011/009044 and Its Translation Into English.
Official Action Dated Oct. 29, 2013 From the US Patent and Trademark Office Re. U.S. Appl. No. 13/059,231.
Seki et al. "Monitoring the Expression Profiles of 7000 *Arabidopsis* Genes Under Drought, Cold and High-Salinity Stresses Using a Full-Length cDNA Microarray", The Plant Journal, 31(3): 279-292, 2002.
Tobias et al. "Structure of the Cinnamyl-Alcohol Dehydrogenase Gene Family in Rice and Promoter Activity of a Member Associated With Lignification", Planta, 220: 678-688, 2005.
Requisition—Sequence Listing Dated May 8, 2013 From the Canadian Intellectual Property Office Re. Application No. 2,753,616.
Communication Pursuant to Article 94(3) EPC Dated Oct. 9, 2013 From the European Patent Office Re. Application No. 08869158.9.
Communication Pursuant to Article 94(3) EPC Dated Aug. 20, 2013 From the European Patent Office Re. Application No. 11172514.9.
Examination Report Dated Jul. 29, 2013 From the Instituto Mexicano de la Propiedad Industrial Re. Application No. MX/a/2010/012697 and its Translation Into English.
International Search Report and the Written Opinion Dated Sep. 1, 2013 From the International Searching Authority Re. Application No. PCT/IB2013/054374.
Invitation to Pay Additional Fees Dated Oct. 16, 2013 From the International Searching Authority Re. Application No. PCT/IL2013/050725.
Office Action Dated Sep. 9, 2013 From the State Intellectual Property Office of the People's Republic of China Re. Application No. 200910217137.1 and Its Translation Into English.
Official Action Dated Sep. 16, 2013 From the US Patent and Trademark Office Re. U.S. Appl. No. 13/125,047.
Official Action Dated Sep. 20, 2013 From the US Patent and Trademark Office Re. U.S. Appl. No. 12/669,975.
Supplementary European Search Report and the European Search Opinion Dated Oct. 15, 2013 From the European Patent Office Re. Application No. 10840687.7.
Translation of Office Action Dated Aug. 28, 2013 From the State Intellectual Property Office of the People's Republic of China Re. Application No. 200880109464.9.
Bennetzen et al. "Setaria Italica Strain Yugu1 SETITScaffold_2_Cont751, Whole Genome Shotgun Sequence", Database NCBI [Online], GenBank Accession No. AGNK01000751, May 11, 2012.
Briggs et al. "Poly(ADP-Ribosyl)ation in Plants", Trends in Plant Science, 16(7): 372-380, Jul. 31, 2011. p. 378.
Clontech "Genome Walker™ Universal Kit User Manual", Clontech Laboratories Inc., Cat. No. 638904, PT3042-1 (PR742239), p. 1-30, Apr. 25, 2007.
Liu et al. "Plant Full Length Insert Polypeptide Seqid 64542", Database Geneseq [Online], XP002713973, Retrieved From EBI Accession No. GSP:ADY08727, Database Accession No. ADY08727, Apr. 21, 2005. Polypeptide Has 96.4% Identity to SEQ ID No. 653 and Is Used for the Same Purpose, Abstract, Sequence.
NCBI "Predicted: Nudix Hydrolase 16, Mitochondrial-Like [*Setaria italica*]", Database NCBI [Online], NCBI Reference Sequence: XP_004955808, Jun. 26, 2013.
Paterson et al. "*Sorghum bicolor* Chromosome 2, Whole Genome Shotgun Sequence", NCBI Database [Online], Retrieved From EBI Accession No. EMBL:CM000761, Database Accession No. CM000761, Jun. 24, 2009. Sequence.
Paterson et al. "SubName: Full=Putative Uncharacterized Protein Sb02g004350", Database UniProt [Online], XP002713972, Retrieved From EBI Accession No. UNIPROT:C5XB01, Database Accession No. C5XB01, Sep. 1, 2009. Polynucleotide and Polypeptide Molecules Fully Comprising the Present Molecules According to SEQ ID No. 166, 653, Abstract, Sequence.
Zhou et al. "Global Genome Expression Analysis of Rice in Response to Drought and High-Salinity Stresses in Shoot, Flag Leaf, and Panicle", Plant Molecular Biology, 63(5): 591-608, Mar. 2007.
International Search Report and the Written Opinion Dated Sep. 7, 2010 From the International Searching Authority Re. Application No. PCT/IB10/50871.
Invitation to Pay Additional Fees Dated Jun. 9, 2011 From the International Searching Authority Re. Application No. PCT/IB10/56023.
Apse et al. "Engineering Salt Tolerance in Plants", Current Opinion in Biotechnology, 13: 146-150, 2002.

(56) References Cited

OTHER PUBLICATIONS

Gaxiola et al. "Drought- and Salt-Tolerant Plants Result From Overexpression of the AVP1 H+-Pump", Proc. Natl. Acad. Sci. USA, PNAS, 98(20): 11444-11449, Sep. 25, 2001.
Gowik et al. "cis-Regulatory Elements for Mesophyll-Specific Gene Expression in the C4 Plant *Flaveria trinervia*, the Promoter of the C4 Phosphoenolpyruvate Carboxylase Gene", The Plant Cell, 16: 1077-1090, 2004.
Hattori et al. "An Acetohydroxy Acid Synthase Mutant Reveals a Single Site Involved in Multiple Herbicide Resistance", Molecular and General Genetics, 246: 419-425, 1995. Abstract!
Holmström et al. "Drought Tolerance in Tobacco", Nature, 379: 683-684, 1996. Abstract!
Jiao et al.
Katavic et al. "Utility of the *Arabidopsis* FAE1 and Yeast SLC1-1 Genes for Improvements in Erucic Acid and Oil Content in Rapeseed", Biochemical Society Transactions, 28: 935-7, 2000. Abstract!
Pilon-Smits et al. "Improved Performance of Transgenic Fructan-Accumulating Tobacco under Drought Stress", Plant Physiology, 107: 125-130, 1995.
Quesada et al. "Genetic Architecture of NaC1 Tolerance in *Arabidopsis*", Plant Physiology, 130: 951-963, 2002. Abstract.
Saijo et al. "Over-Expression of a Single Ca 2+-Dependent Protein Kinase Confers Both Cold and Salt/Drought Tolerance on Rice Plants", The Plant Journal 23(3): 319-327, 2000.
Skriver et al. "Cis-Acting DNA Elements Responsive to Gibberellin and Its Antagonist Abscisic Acid", Proceedings of the National Academy of Sciences USA 88: 7266-7270, 1991.
Tarczynski et al. "Stress Protection of Transgenic Tobacco by Production of the Osmolyte Mannitol", Science, 259: 508-510, 1993. Abstract!
van Haaren et al. "A Functional Map of the Fruit-Specific Promoter of the Tomato 2A11 Gene", Plant Molecular Biology, 21: 625-640, 1993. Abstract!
Vigcolas et al. "Increasing Seed Oil Content in Oil-Seed Rape (*Brassica napus* L.) by Over-Expression of a Yeast Glycerol-3-Phosphate Dehydrogenase Under the Control of a Seed-Specific Promoter", Plant Biotechnology Journal, 5 Issue: 431-441, 2007. Abstract!
Wang et al. "The Soybean Dof-Type Transcription Factor Genes, GmDof4 and GmDof11, Enhance Lipid Content in the Seeds of Transgenic *Arabidopsis* Plants", The Plant Journal, 52: 716-729, 2007. Abstract!
Xu et al. "Expression of a Late Embryogenesis Abundant Protein Gene, HVA1, From Barley Confers Tolerance to Water Deficit and Salt Stress in Transgenic Rice", Plant Physiology, 110: 249-257, 1996.
Yanagisawa et al. "Diversity and Similarity Among Recognition Sequences of Dof Transcription Factors", The Plant Journal, 17(2): 209-214, 1999.
Zabrouskov et al. "Oxidative Metabolism and the Physiological Age of Seed Potatoes Are Affected by Increased Alpha-Linolenate Content", Physiologia Plantarum, 116: 172-185, 2002.
Communication Pursuant to Rules 70(2) and 70a(2) EPC and Reference to Rule 39(1) EPC Dated Dec. 5, 2011 From the European Patent Office Re. Application No. 10194223.3.
Communication Pursuant to Rules 70(2) and 70a(2) EPC and Reference to Rule 39(1) EPC Dated Nov. 7, 2011 From the European Patent Office Re. Application No. 11172514.9.
Examiner's Report Dated Jan. 10, 2012 From the Australian Government, IP Australia Re. Application No. 2005234725.
Official Action Dated Dec. 21, 2011 From the US Patent and Trademark Office Re. U.S. Appl. No. 12/810,855.
Response Dated Jan. 10, 2012 to European Search Report and the European Search Opinion of Jun. 14, 2011 From the European Patent Office Re. Application No. 11154193.4.
Aharon et al. "Overexpression of a Plasma Membrane Aquaporin in Transgenic Tobacco Improves Plant Vigor Under Favorable Growth Conditions But Not Under Drought or Salt Stress", The Plant Cell, 15: 439-447, Feb. 2003.
Davletova et al. "The Zinc-Finger Protein Zat12 Plays a Central Role in Reactive Oxygen and Abiotic Stress Signaling in *Arabidopsis*", Plant Physiology, 139: 847-856, Oct. 2005.
Friedberg "Automated Protein Function Prediction—The Genomic Challenge", Briefings in Bioinformatics 7(3): 225-242, 2006.
Communication Pursuant to Article 94(3) EPC Dated Jan. 12, 2011 From the European Patent Office Re. Application No. 08867385.0.
Communication Pursuant to Article 94(3) EPC Dated Dec. 21, 2010 From the European Patent Office Re. Application No. 08866783.7.
Communication Pursuant to Rule 58 EPC or Rule 159 EPC, Invitation to Remedy Deficiencies in the Application Documents Dated Jan. 19, 2012 From the European Patent Office Re. Application No. 11190922.2.
Communication Pursuant to Rules 70(2) and 70a(2) EPC Dated Jan. 19, 2012 From the European Patent Office Re. Application No. 09807983.3.
International Preliminary Report on Patentability Dated Oct. 7, 2010 From the International Bureau of WIPO Re. Application No. PCT/IL2008/001684.
International Preliminary Report on Patentability Dated Jul. 15, 2010 From the International Bureau of WIPO Re. Application No. PCT/IL2008/001683.
International Preliminary Report on Patentability Dated Jul. 15, 2010 From the International Bureau of WIPO Re. Application No. PCT/IL2008/001685.
International Search Report Dated Jun. 2, 2009 From the International Searching Authority Re.: Application No. PCT/IL2008/001683.
International Search Report Dated Apr. 14, 2009 From the International Searching Authority Re.: Application No. PCT/IL2008/001684.
International Search Report Dated May 18, 2009 From International Searching Authority Re.: Application No. PCT/IL2008/001685.
Response Dated Jul. 12, 2011 to Communication Pursuant to Article 94(3) EPC of Jan. 12, 2011 From the European Patent Office Re. Application No. 08867385.0.
Response Dated Jun. 21, 2011 to Communication Pursuant to Article 94(3) EPC of Dec. 21, 2010 From the European Patent Office Re. Application No. 08866783.7.
Translation of Office Action Dated Jun. 22, 2011 From the State Intellectual Property Office of the People's Republic of China Re. Application No. 200880127685.9.
Written Opinion Dated Jun. 2, 2009 From the International Searching Authority Re.: Application No. PCT/IL2008/001683.
Written Opinion Dated Apr. 14, 2009 From the International Searching Authority Re.: Application No. PCT/IL2008/001684.
Written Opinion Dated May 18, 2009 From the International Searching Authority Re.: Application No. PCT/IL2008/001685.
Agostini et al. "Evaluation of Feature-Based Registration in Dynamic Infrared Imaging for Breast Cancer Diagnosis", Proceedings of the 28th IEEE EMBS (Engineering in Medicine and Biology) Annual International Conference, New York City, USA Aug. 30-Sep. 3, 2006, XP031235634, p. 953-956, Aug. 30, 2006. p. 953, § 2, 3.
Akscnov et al. "3D Thermography for Quantification of Heat Generation Resulting From Inflammation", Proceedings of the 8th 3D Modelling Symposium, Paris, France, XP))2523191, 11 P., 2003.
Bichinho et al. "A Computer Tool for the Fusion and Visualization of Thermal and Magnetic Resonance Images", Journal of Digital Imaging, XP002527797, 22(5): 527-534, Oct. 2009. p. 3, col. 1, Line 5-col. 2, Line 6, Fig.1.
Deng et al. "Enhancement of Thermal Diagnostics on Tumors Underneath the Skin by Induced Evaporation", Proceedings of the 2005 27th Annual International Conference of the Engineering in Medicine and Biology Society, Shanghai, China, Sep. 1-4, 2005, IEEE-EMBS 2005, XP002519610, 7: 7525-7528, 2005. Passage Bridging p. 7526 and p. 7527, Abstract, Figs.4, 5.
Deng et al. "Mathematical Modeling of Temperature Mapping Over Skin Surface and Its Implementation in Thermal Disease Diagnostics", Computers in Biology and Medicine, XP002523192, 34(6): 495-521, Sep. 2004. Abstract, p. 497.
Kaczmarek et al. "Optical Excitation Methods in Active Dynamic Thermography in Medical Diagnostics", Proceedings of the SPIE—

(56) References Cited

OTHER PUBLICATIONS

The International Society for Optical Engineering SPIE, XP002519609, 5566(1): 120-126, 2004. p. 121, Last §, p. 123, First §, Fig.3.
Lipari et al. "Advanced Infrared Image Processing for Breast Cancer Risk Assessment", Proceedings of the 19th Annual International Conference of the IEEE/EMBS Engineering in Medicine and Biology Society, Chicago, IL, USA, Oct. 30-Nov. 2, 1997, XP010325780, 2: 673-676, Oct. 30, 1997. Abstract, Sections II, III, Fig.3.
Tan et al. "A Novel Cognitive Interpretation of Breast Cancer Thermography With Complementary Learning Fuzzy Neural Memory Structure", Expert Systems With Applications, XP005919120, 33(3): 652-666, Mar. 13, 2007. Abstract, p. 658-659, 4, Section 4, Fig.5.
European Search Report and the European Search Opinion Dated Oct. 6, 2011 From the European Patent Office Re. Application No. 11172514.9.
Taliercio et al. "GH_TMIRS_129_G10_F Cooton Normalized Library dT Primed *Gossypium hirsutum* cDNA, mRNA Sequence", EMBL-Bank, XP002659970, Retrieved From EBI Accession No. EM_EST:DW508992, Database Accession No. DW508992, Jun. 30, 2006.
Taliercio et al. "GH_TMIRS_129_G10_R Cotton Normalized Library dT Primed *Gossypium hirsutum* cDNA, mRNA Sequence", EMBL-Bank, XP002659971, Retrieved From EBI Accession No. EM_EST:DW508993, Database Accession No. DW508993, Jun. 30, 2006.
Communication Pursuant to Article 93(3) EPC Dated Jun. 15, 2012 From the European Patent Office Re. Application No. 11154193.4.
Communication Pursuant to Article 94(3) EPC Dated Jun. 21, 2012 From the European Patent Office Re. Application No. 11154213.0.
Official Action Dated Jun. 13, 2012 From the US Patent and Trademark Office Re. U.S. Appl. No. 12/594,853.
Communication Pursuant to Article 94(3) EPC Dated Dec. 8, 2008 From the European Patent Office Re.: Application No. 04734072.4.
International Preliminary Report on Patentability Dated Dec. 8, 2005 From the International Bureau of WIPO Re.: Application No. PCT/IL2004/000431.
International Preliminary Report on Patentability Dated Jan. 22, 2009 From the International Bureau of WIPO Re.: Application No. PCT/IL2006/001223.
Invitation to Pay Additional Fees Dated Feb. 7, 2008 From the International Searching Authority Re.: Application No. PCT/IL06/001223.
Invitation to Pay Additional Fees Dated Dec. 18, 2008 From the International Searching Authority Re.: Application No. PCT/IL08/01024.
Communication Pursuant to Article 94(3) EPC Dated Sep. 9, 2009 From the European Patent Office Re.: Application No. 04734072.4.
Communication Pursuant to Article 94(3) EPC Dated May 12, 2010 From the European Patent Office Re.: Application No. 06766224.7.
Communication Pursuant to Article 94(3) EPC Dated Feb. 13, 2009 From the European Patent Office Re.: Application No. 05750089.4.
Communication Pursuant to Article 94(3) EPC Dated Nov. 27, 2009 From the European Patent Office Re.: Application No. 06809784.9.
Communication Pursuant to Rule 70(2) EPC and Reference to Rule 39(1) EPC Dated Sep. 13, 2010 From the European Patent Office Re.: Application No. 09163033.5.
Communication Relating to the Results of the Partial International Search Dated Jul. 8, 2009 From the International Searching Authority Re.: Application No. PCT/IL2008/001657.
European Search Report and the European Search Opinion Dated Aug. 9, 2010 From the European Patent Office Re.: Application No. 09163033.5.
Examination Report Dated Nov. 3, 2010 From the Government of India, Patent Office Re.: Application No. 158/CHENP/2007.
Examination Report Dated Nov. 13, 2007 From the Government of India, Patent Office Re.: Application No. 3482/CHENP/2005.
Examination Report Dated Feb. 17, 2010 From the Instituto Mexicano de la Propriedad Industrial Re. Application No. PA/a/2005/012565 and Its Summary in English.
Examination Report Dated Sep. 22, 2010 From the Instituto Mexicano de la Propriedad Industrial Re. Application No. MX/a/2008/005280 and Its Summary Into English.
Examiner's Report Dated Dec. 17, 2009 From the Australian Patent Office Re.: Application No. 2005252469.
International Preliminary Report on Patentability Dated Feb. 4, 2010 From the International Bureau of WIPO Re.: Application No. PCT/IL2008/001024.
International Preliminary Report on Patentability Dated Jul. 8, 2010 From the International Bureau of WIPO Re.: Application No. PCT/IL2008/001657.
International Preliminary Report on Patentability Dated Jan. 14, 2010 From the International Bureau of WIPO Re.: Application No. PCT/IL2008/000489.
International Preliminary Report on Patentability Dated Jan. 21, 2010 From the International Bureau of WIPO Re.: Application No. PCT/IL2007/001590.
International Preliminary Report on Patentability Dated Jan. 22, 2009 From the International Bureau of WIPO Re.: Application No. PCT/IL2006/000947.
International Preliminary Report on Patentability Dated Mar. 29, 2007 From the International Bureau of WIPO Re.: Application No. PCT/IL2005/000627.
International Preliminary Report on Patentability Dated Jan. 30, 2007 From the International Bureau of WIPO Re.: Application No. PCT/IL05/00627.
International Search Report and the Written Opinion Dated Feb. 17, 2010 From the International Searching Authority Re.: Application No. PCT/IL09/00508.
International Search Report and the Written Opinion Dated Nov. 24, 2008 From the international Searching Authority Re.: Application No. PCT/IL08/00489.
International Search Report and the Written Opinion Dated Jul. 29, 2008 From the International Searching Authority Re.: Application No. PCT/IL06/001223.
International Search Report and the Written Opinion Dated Oct. 30, 2009 From the International Searching Authority Re.: Application No. PCT/IL2008/001657.
International Search Report Dated Jul. 2, 2009 From the International Searching Authority Re.: Application No. PCT/IL07/01590.
International Search Report Dated Jan. 3, 2007 From the International Searching Authority Re.: Application No. PCT/IL2005/000627.
International Search Report Dated Mar. 4, 2009 From the International Searching Authority Re.: Application No. PCT/IL08/01024.
International Search Report Dated Nov. 4, 2005 From the International Searching Authority Re.: Application No. PCT/IL04/00431.
International Search Report Dated Aug. 27, 2008 From the International Searching Authority Re.: Application No. PCT/IL06/00947.
Invitation to Pay Additional Fees Dated Sep. 8, 2006 From the International Searching Authority Re.: Application No. PCT/IL05/00627.
Invitation to Pay Additional Fees Dated Nov. 19, 2009 From the International Searching Authority Re.: Application No. PCT/IL09/00508.
Invitation to Pay Additional Fees Dated Aug. 23, 2005 From the International Search Authority Re. Application No. PCT/IL2004/000431.
Notice of Allowance Dated Aug. 11, 2010 From the Instituto Mexicano de la Propriedad Industrial Re. Application No. PA/a/2005/012565.
Notice of Allowance Dated Apr. 16, 2010 From the US Patent and Trademark Office Re.: U.S. Appl. No. 11/629,411.
Office Action Dated Aug. 4, 2010 From the Israel Patent Office Re.: Application No. 172135 and Its Translation Into English.
Office Action Dated Jan. 9, 2009 From the State Intellectual Property Office of the People's Republic of China Re.: Application No. 200480020597.0.
Office Action Dated May 13, 2010 From the Israel Patent Office Re. Application No. 180022 and Its Translation Into English.

(56) References Cited

OTHER PUBLICATIONS

Office Action Dated Jun. 17, 2010 From the Israel Patent Office Re. Application No. 190918 and Its Translation Into English.
Office Action Dated Oct. 18, 2010 From the Israel Patent Office Re. Application No. 180022 and Its Translation Into English.
Office Action Dated Jan. 22, 2010 From the State Intellectual Property Office of the People's Republic of China Re.: Application No. 200580027481.4 and Its Translation Into English.
Office Action Dated Apr. 27, 2009 From the Israeli Patent Office Re.: Application No. 172135 and Its Translation Into English.
Office Action Dated Jan. 31, 2010 From the Israel Patent Office Re.: Application No. 172135 and Its Translation Into English.
Office Letter Dated Jul. 7, 2008 From the Government of India, Patent Office Re.: Application No. 3482/CHENP/2005.
Official Action Dated May 1, 2009 From the US Patent and Trademark Office Re.: U.S. Appl. No. 11/629,411.
Official Action Dated Sep. 2, 2009 From the US Patent and Trademark Office Re.: U.S. Appl. No. 11/629,411.
Official Action Dated Jun. 8, 2010 From the US Patent and Trademark Office Re.: U.S. Appl. No. 11/629,411.
Official Action Dated May 15, 2009 From the US Patent and Trademark Office Re.: U.S. Appl. No. 11/990,386.
Official Action Dated Aug. 18, 2010 From the US Patent and Trademark Office Re. U.S. Appl. No. 12/083,978.
Official Action Dated Oct. 18, 2007 From the US Patent and Trademark Office Re.: U.S. Appl. No. 11/284,236.
Official Action Dated Oct. 22, 2009 From the US Patent and Trademark Office Re.: U.S. Appl. No. 11/990,386.
Official Action Dated Jul. 28, 2008 From the US Patent and Trademark Office Re.: U.S. Appl. No. 11/284,236.
Partial European Search Report Dated Apr. 19, 2010 From the European Patent Office Re.: Application No. 09163033.5.
Response Dated Jan. 4, 2010 to Official Action of Sep. 2, 2009 From the US Patent and Trademark Office Re.: U.S. Appl. No. 11/629,411.
Response Dated Jan. 7, 2010 to Communication Pursuant to Article 94(3) EPC of Sep. 9, 2009 From the European Patent Office Re.: Application No. 04734072.4.
Response Dated Oct. 12, 2010 to Communication Pursuant to Article 94(3) EPC of May 12, 2010 From the European Patent Office Re.: Application No. 06766224.7.
Response Dated Sep. 13, 2010 to Office Action Dated May 13, 2010 From the Israel Patent Office Re. Application No. 180022.
Response Dated Oct. 14, 2010 to Office Action of Jun. 17, 2010 From the Israel Patent Office Re. Application No. 190918.
Response Dated May 17, 2010 to Office Action of Jan. 22, 2010 From the State Intellectual Property Office of the People's Republic of China Re.: Application No. 200580027481.4.
Response Dated Sep. 21, 2010 to Notice of Allowance of Apr. 16, 2010 From the US Patent and Trademark Office Re.: U.S. Appl. No. 11/629,411.
Response Dated Feb. 22, 2010 to Official Action of Oct. 22, 2009 From the US Patent and Trademark Office Re.: U.S. Appl. No. 11/990,386.
Response Dated Jun. 29, 2010 to Examination Report of Feb. 17, 2010 From the Instituto Mexicano de la Propriedad Industrial Re. Application No. PA/a/2005/012565.
Response Dated May 31, 2010 to Office Action of Jan. 31, 2010 From the Israel Patent Office Re.: Application No. 172135.
Supplementary European Search Report and the European Search Opinion Dated Feb. 1, 2010 From the European Patent Office Re.: Application No. 06766224.7.
Supplementary European Search Report and the European Search Opinion Dated Jul. 1, 2010 From the European Patent Office Re. Application No. 07849616.3.
Supplementary European Search Report and the European Search Opinion Dated Aug. 11, 2010 From the European Patent Office Re. Application No. 08738191.9.
Supplementary European Search Report and the European Search Opinion Dated Sep. 14, 2009 From the European Patent Office Re.: Application No. 06809784.9.
Supplementary European Search Report and the European Search Opinion Dated Jul. 29, 2010 From the European Patent Office Re. Application No. 08776651.5.
Supplementary European Search Report Dated Apr. 23, 2008 From the European Patent Office Re.: Application No. 05750089.4.
Supplementary European Search Report Dated Oct. 31, 2007 From the European Patent Office Re.: Application No. 04734072.4.
Supplementary Partial European Search Report Dated Aug. 30, 2007 From the European Patent Office Re.: Application No. 04734072.4.
Translation of Notice of Payment of the Restoration Fee for Unity of Invention Dated Mar. 20, 2009 From the State Intellectual Property Office of the People's Republic of China Re.: Application No. 200580027481.4.
Translation of the Office Action Dated Jan. 9, 2009 From the State Intellectual Property Office Re.: Application No. 2004800200597.0.
Written Opinion Dated Jul. 2, 2009 From the International Searching Authority Re.: Application No. PCT/IL07/01590.
Written Opinion Dated Jan. 3, 2007 From the International Searching Authority Re.: Application No. PCT/IL2005/000627.
Written Opinion Dated Mar. 4, 2009 From the International Searching Authority Re.: Application No. PCT/IL08/01024.
Written Opinion Dated Nov. 4, 2005 From the International Searching Authority Re.: Application No. PCT/IL04/00431.
Written Opinion Dated Aug. 27, 2008 From the International Searching Authority Re.: Application No. PCT/IL06/00947.
Alcala et al. "Generation of ESTs From Tomato Fruit Tissue", Database GenBank on STIC, National Center for Biotechnology Information, Accession No. AW932839, 2001.
Blewitt et al. "BNLGHi10083 Six-Day Cotton Fiber *Gossypium hirsutum* cDNA 5' Similar to (AC004521) Unknown Protein [*Arabidopsis thaliana*], mRNA Sequence", XP002576188, Retrieved Fron EBI Accession No EMBL:A1728187, Database Accession No. AI728187, Jun. 12, 1999. Sequence.
Blewitt et al. "BNLGHi8081 Six-Day Cotton Fiber *Gossypium hirsutum* cDNA 5' Similar to (AC004521) Unknown Protein [*Arabidopsis thalian*], mRNA Sequence", XP002576189, Retrieved From EBI Accesion No. EMBL:AI730835, Database Accession No. AI730835, Jun. 12, 1999. Sequence.
Blewitt et al. "BNLGHi8396 Six-Day Cotton Fiber *Gossypium hirsutum* cDNA 5' Similar to (AC004521) Unknown Protein [*Arabidopsis thaliana*], mRNA Sequence", XP002576190, Retrieved From EBI Accession No. Embl:AI27553, Database Accession No. AI27553, Jun. 12, 1999. Sequence.
Bowie et al. "Deciphering the Message in Protein Sequences: Tolerance to Amino Acid Substitutions", Science, 247(4948): 1306-1310, Mar. 16, 1990.
Brandle et al. "Perspectives on the Production of Recombinant Proteins in Plants", AgBiotechNet, 3(ABN 070): 1-4, 2001. Abstract.
Cheuk et al. "*Arabidopsis thaliana* At2g46960/F14M4.21 mRNA, Complete CDS", Database EMBL [Online], XP002593835, Retrieved From EBI Accession No. EMBL:AY091688, Database Accession No. AY091688, Apr. 14, 2002.
François et al. "Overexpression of the VvLTP1 Gene Interferes With Somatic Embryo Development in Grapevine", Functional Plant Biology, 35(5): 394-402, 2008.
Fray et al. "Nucleotide Sequence and Expression of a Ripening and Water Stress-Related cDNA From tomato With Homology to the MIP Class of Membrane Channel Proteins", Plant Molecular Biology [Online], XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=Ramp, Oct. 1, 1994.
Gardiner et al. "*Zea mays* PCO131392 mRNA Sequence", Database EMBL/GenBank/DDBJ, EBI Database Accession No. AY107021, XP002542347, May 28 2002. 96,5% Identity in 1118 nt Overlap of AY107021 (1118 nt) With Seq Id No. 68 (1348 nt) of the Present Application, Abstract.
Grover et al. "Understanding Molecular Alphabets of the Plant Abiotic Stress Responses", Current Science, 80(2): 206-216, Jan. 25, 2001.
Guo et al. "Protein Tolerance to Random Amino Acid Change", Proceedings of the National Academy of Sciences USA, 101(25): 9205-9210, 2004.

(56) References Cited

OTHER PUBLICATIONS

Hachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, col. 1, § 2—p. 1153, col. 1, § 1, Table 1.
Hill et al. "Functional Analysis of Conserved Histidines in ADP-Glucose Pyrophosphorylase From *Escherichia coli*", Biochemical and Biophysical Research Communications, 244(2): 573-577, 1998.
In et al. "Panax Gingseng mRNA for Cytoplasmic Ribosomal Protein S13, Complete Cds", Database EMBL [Online], Retrieved From EBI Accession No. EMBL, Database Accession No. AB043974, 2000.
Ji et al. "*Gossypium hirsutum* Expansin mRNA, Complete CDs", XP002474936, Retrieved From EBI Accession No. EMBL:AY189969, Database Accession No. AY189969, 2003.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.
Keskin et al. "A New, Structurally Nonredundant, Diverse Data Set of Protein-Protein Interfaces and Its Implications", Protein Science, 13: 1043-1055, 2004.
Kim et al. "*Arabidopsis thaliana* At2g46960/F14M4.21 mRNA, Complete CDS", Database EMBL [Online], XP002593834, Retrieved From EBI Accession No. EMBL:AF367329, Database Accession No. AF367329, Apr. 12, 2001.
Kim et al. "Molecular Cloning of Low-Temperature-Inducible Ribosomal Proteins From Soybean", Journal of Experimental Botany, 55(399): 1153-1155, 2004.
Kirkness et al. "*Lycopersicon esculentum* Clone 133453R, mRNA Sequence", Database EMBL [Online], XP002529190, Retrieved From EBI Accession No. EMBL:BT014251, Database Accession No. BT014251, May 12, 2004.
Kirubakaran et al. "Characterization of a New Antifungal Lipid Transfer Protein From Wheat", Plant Physiology and Biochemistry, 46: 918-927, 2008.
Liu et al. "Root-Specific Expression of a Western White Pine PR10 Gene Is Mediated by Different Promoter Regions in Transgenic Tobacco", Plant Molecular Biology, 52: 103-120, 2003.
Maurel "Plant Aquaporins: Novel Functions and Regulation Properties", FEBS Letters, XP022078418, 581(12): 2227-2236, May 25, 2007. p. 2230, col. 2, Last §—p. 2231, col.1, § 2, Fig.1.
McConnell et al. "Role of Phabulosa and Phavoluta in Determining Radial Patterning in Shoots", Nature, 411(6338): 709-713, Jun. 7, 2001.
Merriam-Webster "Exogenous Definition", Merrian-Webster On-Line Dictionary, 2010.
NCBI "Protein Sequence (588 Letters)", NCBI BLAST Basic Local Alignment Search Tool, 3 P., Retrieved From the Internet on Nov. 24, 2009.
Ngo et al. "Computational Complexity, Protein Structure Prediction, and the Levinthal Paradox", The Protein Folding Problem and Tertiary Structure Prediction, p. 433, 492-495.
Nuccio et al. "Metabolic Engineering of Plants for Osmotic Stress Resistance", Current Opinion in Plant Biology, XP002216348, 2(2): 128-134, Apr. 1, 1999.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig.1.
Orzaez et al. "Agroinjection of Tomato Fruits. A Tool for Rapid Functional Analysis of Transgenes Directly in Fruit", Plant Physiology, 140: 3-11, 2006.
Park et al. "*Glycine max* Ribosomal Protein S13 (RPS13) mRNA, Complete Cds", Database EMBL [Online], Retreieved From EBI Accession No. EMBL, Database Accession No. AY453393, 2004.
Sáez-Vásquez et al. "Accumulation and Nuclear Targeting of BnC24, a *Brassica napus* Ribosomal Protein Corresponding to a mRNA Accumulating in Response to Cold Treatment", Plant Science, 156(1): 35-46, 2000.
Smart et al. "MIP Genes Are Down-Regulated Under Drought Stress in *Nicotiana glauca*", Plant and Cell Physiology, 42(7): 686-693, 2001. Referenc to Database Entry AF290618 on p. 686, p. 692, 1-h col. § 2.
Smart et al. "*Nicotiana glauca* Putative Delta Tip (MIP2) mRNA, Complete Cds", Database EMBL [Online], Retrieved From EBI Accession No. EBML: Af290618, Database Accession No. AF290618.
Tamura et al. "Osmotic Stress Tolerance of Transgenic Tobacco Expressing a Gene Encoding a Membrane-Located Receptor-Like Protein From Tobacco Plants", Plant Physiology, 131(2): 454-462, 2003.
Tanaka et al. "Enhanced Tolerance Against Salt-Stress and Freezing-Stress of *Escherichia coli* Cells Expressing Algal BBC1 Gene", Current Microbiology, 42(3): 173-177, 2001.
Thornton et al. "From Structure to Function: Approaches and Limitations", Nature Structural Biology. Structural Genomic Supplement, Nov. 2000, p. 991-994.
Udall et al. "A Global Assembly of Cotton ESTs", Genome Research, 16(3): 441-450, 2006.
Van der Hoeven et al. "EST301294 Tomato Root During/After Fruit Set, Cornell University *Lycopersicon esculentum* cDNA Clone cLEX1K11 Similar to *Vernicia fordii* Aquaporin, mRNA Sequence", Database EMBL [Online], Retrieved From EBI Accession No. EMBL: AW218814, Database Accession No. AW218814. Abstract, May 18, 2001.
Van der Hoeven et al. "EST301295 Tomato Root During/After Fruit Set, Cornell University *Lycopersicon esculentum* cDNA Clone cLEX1K11 Similar to *Vernicia fordii* Aquaporin, mRNA Sequence", Database EMBL [Online], Retrieved From EBI Accession No. EMBL: AW218815, Database Accession No. AW218815. Abstract, May 18, 2001.
Van der Hoeven et al. "EST428934 Tomato Nutrient Deficient Roots *Lycopersicon esculentum* cDNA Clone cLEW26B2 5' Sequence, mRNA Sequence", Database EMBL, Retrieved From EBI Accession No. EMBL, Database Accession No. BF098413, 2000, Oct. 19, 2000.
Wallace et al. "Oligonucleotide Probes for the Screening of Recombinant DNA Libraries", Methods in Enzymology, XP002957829, 152: 432-442, Jan. 1, 1987.
Wells "Additivity of Mutational Effects in Proteins", Biochemistry, 29 (37): 8509-8517, 1990.
Wing et al. "An Integrated Analysis of the Genetics, Devlopment, and Evolution of Cotton Fiber", NBCI GenBank Accession No. BE052336, 2000.
Wing et al. "GA_Eb0023F09f *Gossypium arboreum* 7-10 Dpa Fiber Library *Gossypium arboreum* cDNA Clone GA_Eb0023F09f, mRNA Sequence", XP002576191, Retrieved From EBI Accession No. EMBL:BF275177, Database Accession No. BF275177, Nov. 20, 2000. Sequence.
Wu et al. "SubName: Full=Major Intrinsic Protein", Database UniProt [Online], XP002529191, Retrieved From EBI Accession No. UNIPROT:AOFI89, Database Accession No. AOFI89, Nov. 28, 2006.
Yamada e tal. "*Arabidopsis thaliana* Clone RAFL14-87-A16 (R20399) Unknown Protein (At1g60770) mRNA, Complete Cds", GenBank Accession No. BT002876, Retrieved From the internet, Jan. 21, 2010.
Communication Pursuant to Rules 70(2) and 70a(2) EPC Dated Mar. 5, 2013 From the European Patent Office Re. Application No. 10785834.2.
Requisition by the Examiner Dated Feb. 12, 2013 From the Canadian Intellectual Property Office Re. Application No. 2,570,195.
Translation of Office Action Dated Jan. 17, 2013 From the State Intellectual Property Office of the People's Republic of China Re. Application No. 201110104274.1.
Translation of Search Report Dated Jan. 17, 2013 From the State Intellectual Property Office of the People's Republic of China Re. Application No. 201110104274.1.
International Preliminary Report on Patentability Dated Jul. 4, 2013 From the International Bureau of WIPO Re. Application No. PCT/IB2011/055854.

* cited by examiner

FIG. 1A
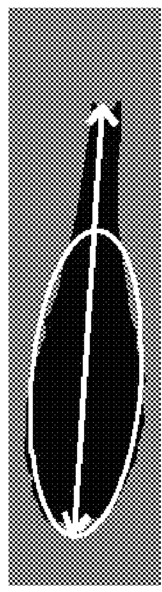
Leaf length is represented by the arrow
FIG. 1B
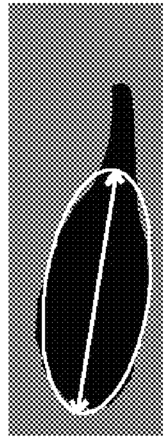
Laminar length is represented by the arrow
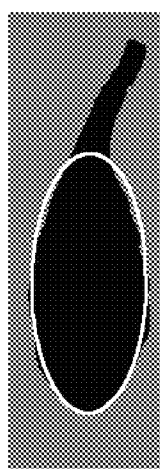
White ellipse represents the laminar area
FIG. 1C
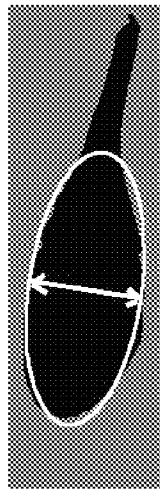
Laminar width is represented by the arrow
FIG. 1D

ISOLATED POLYNUCLEOTIDES AND POLYPEPTIDES AND METHODS OF USING SAME FOR INCREASING PLANT UTILITY

RELATED APPLICATIONS

This Application is a National Phase of PCT Patent Application No. PCT/IL2009/000508 having International filing date of May 21, 2009, which claims the benefit of U.S. Provisional Patent Application Nos. 61/071,885 filed on May 22, 2008 and 61/129,296 filed on Jun. 17, 2008. The contents of the above Applications are all incorporated herein by reference.

FIELD AND BACKGROUND OF THE INVENTION

The present invention, in some embodiments thereof, relates to polypeptides, polynucleotides encoding same, transgenic plants expressing same and methods of producing and using same, and, more particularly, but not exclusively, to methods of increasing plant yield, oil yield, seed yield, biomass, growth rate, vigor, oil content, abiotic stress tolerance and/or nitrogen use efficiency.

Abiotic stress conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress (ABS) and thus necessitate optimal growth conditions for commercial crop yields. Continuous exposure to stress causes major alterations in the plant metabolism which ultimately leads to cell death and consequently yield losses.

The global shortage of water supply is one of the most severe agricultural problems affecting plant growth and crop yield and efforts are made to mitigate the harmful effects of desertification and salinization of the world's arable land. Thus, Agbiotech companies attempt to create new crop varieties which are tolerant to different abiotic stresses focusing mainly in developing new varieties that can tolerate water shortage for longer periods.

Suboptimal nutrient (macro and micro nutrient) affect plant growth and development through the whole plant life cycle. One of the essential macronutrients for the plant is Nitrogen. Nitrogen is responsible for biosynthesis of amino acids and nucleic acids, prosthetic groups, plant hormones, plant chemical defenses, and the like. Nitrogen is often the rate-limiting element in plant growth and all field crops have a fundamental dependence on inorganic nitrogenous fertilizer. Since fertilizer is rapidly depleted from most soil types, it must be supplied to growing crops two or three times during the growing season. Additional important macronutrients are Phosphorous (P) and Potassium (K), which have a direct correlation to yield and general plant tolerance.

Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing consumption of plant oils as bio-fuel is the oil price, which is still higher than fossil fuel [eia (dot) doe (dot) gov/oiaf/analysispaper/biodiesel/; njbiz (dot)com/weekly_article.asp?aID=19755147 (dot) 6122555 (dot) 957931 (dot) 7393254 (dot) 4337383 (dot) 561&aID2=73678]. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants.

Genes known to be involved in increasing plant oil yields include those participating in fatty acid synthesis or sequestering such as desaturase [e.g., DELTA6, DELTA12 or acyl-ACP (Ssi2; Arabidopsis Information Resource (TAIR; arabidopsis (dot) org/), TAIR No. AT2G43710)], OleosinA (TAIR No. AT3G01570) or FAD3 (TAIR No. AT2G29980), and various transcription factors and activators such as Lec1 [TAIR No. AT1G21970, Lotan et al. 1998. *Cell.* 26; 93(7): 1195-205], Lec2 [TAIR No. AT1G28300, Santos Mendoza et al. 2005, *FEBS Lett.* 579(20:4666-70], Fus3 (TAIR No. AT3G26790), ABI3 [TAIR No. AT3G24650, Lara et al. 2003. J Biol Chem. 278(23): 21003-11] and Wri1 [TAIR No. AT3G54320, Cernac and Benning, 2004. Plant J. 40(4): 575-85].

Zabrouskov V., et al., 2002 (Physiol Plant. 116:172-185) describe an increase in the total lipid fraction by upregulation of endoplasmic reticulum (FAD3) and plastidal (FAD7) fatty acid desaturases in potato.

Wang H W et al., 2007 (Plant J. 52:716-29. Epub 2007 Sep. 18) describe an increase in the content of total fatty acids and lipids in plant seeds by over-expressing the GmDof4 and GmDof11 transcription factors.

Vigeolas H, et al. [Plant Biotechnol J. 2007, 5(3):431-41] and U.S. Pat. Appl. No. 20060168684 discloses an increase in seed oil content in oil-seed rape (*Brassica napus* L.) by over-expression of a yeast glycerol-3-phosphate dehydrogenase under the control of a seed-specific promoter.

Katavic V, et al., 2000 (Biochem Soc Trans. 28:935-7) describe the use of the Arabidopsis FAE1 and yeast SLC1-1 genes for improvements in erucic acid and oil content in rapeseed.

U.S. Pat. Appl. No. 20080076179 discloses an isolated moss nucleic acid encoding a lipid metabolism protein (LMP) and transgenic plants expressing same with increased lipid levels.

U.S. Pat. Appl. No. 20060206961 discloses a method of increasing oil content in plants (e.g., in plant seeds), by expressing in the plant the Ypr140w polypeptide.

U.S. Pat. Appl. No. 20060174373 discloses a method of increasing oil content in plants by expressing a nucleic acid encoding a triacylglycerols (TAG) synthesis enhancing protein (TEP) in the plant.

U.S. Pat. Appl. Nos. 20070169219, 20070006345, 20070006346 and 20060195943, disclose transgenic plants with improved nitrogen use efficiency which can be used for the conversion into fuel or chemical feedstocks.

WO2004/104162 teaches polynucleotide sequences and methods of utilizing same for increasing the tolerance of a plant to abiotic stresses and/or increasing the biomass of a plant.

WO2007/020638 teaches polynucleotide sequences and methods of utilizing same for increasing the tolerance of a plant to abiotic stresses and/or increasing the biomass, vigor and/or yield of a plant.

WO2008/122890 teaches polynucleotide sequences and methods of utilizing same for increasing oil content, growth rate, biomass, yield and/or vigor of a plant.

SUMMARY OF THE INVENTION

According to an aspect of some embodiments of the present invention there is provided a method of increasing oil content, yield, growth rate, biomass, vigor, abiotic stress tolerance and/or nitrogen use efficiency of a plant, comprising expressing within the plant an exogenous polynucleotide comprising a nucleic acid sequence at least 80% identical to SEQ ID NOs:18, 1-16, 19-50, 101-378, 657-672, 674-706, 716-719, 724-741 and 755-763 with the proviso that the nucleic acid sequence is not as set forth by SEQ ID NO:756 or 762, thereby increasing the oil content, yield, growth rate, biomass, vigor, abiotic stress tolerance and/or nitrogen use efficiency of the plant.

According to an aspect of some embodiments of the present invention there is provided a method of increasing oil content, yield, growth rate, biomass, vigor, abiotic stress tolerance and/or nitrogen use efficiency of a plant, comprising expressing within the plant an exogenous polynucleotide comprising the nucleic acid sequence selected from the group consisting of SEQ ID NOs:18, 1-16, 19-50, 101-378, 657-672, 674-706, 716-719, 724-741, 755, 757-761 and 763, thereby increasing the oil content, yield, growth rate, biomass, vigor, abiotic stress tolerance and/or nitrogen use efficiency of the plant.

According to an aspect of some embodiments of the present invention there is provided a method of increasing oil content, yield, growth rate, biomass, vigor, abiotic stress tolerance and/or nitrogen use efficiency of a plant, comprising transforming the plant with an exogenous polynucleotide capable of downregulating the expression level of a nucleic acid sequence at least 80% identical to SEQ ID NO:17 or 673, thereby increasing the oil content, yield, growth rate, biomass, vigor, abiotic stress tolerance and/or nitrogen use efficiency of the plant.

According to an aspect of some embodiments of the present invention there is provided a method of increasing oil content, yield, growth rate, biomass, vigor, abiotic stress tolerance and/or nitrogen use efficiency of a plant, comprising transforming the plant with an exogenous polynucleotide capable of downregulating the expression level of the nucleic acid sequence set forth in SEQ ID NO:17 or 673, thereby increasing the oil content, yield, growth rate, biomass, vigor, abiotic stress tolerance and/or nitrogen use efficiency of the plant.

According to an aspect of some embodiments of the present invention there is provided a method of producing oil, comprising: (a) providing the plant according to the method of the invention; and (b) extracting the oil from the plant; thereby producing the oil.

According to an aspect of some embodiments of the present invention there is provided an isolated polynucleotide comprising a nucleic acid sequence at least 80% identical to SEQ ID NOs:18, 1-16, 19-50, 101-378, 657-672, 674-706, 716-719, 724-741 and 755-763 with the proviso that the nucleic acid sequence is not as set forth by SEQ ID NO:756 or 762.

According to an aspect of some embodiments of the present invention there is provided an isolated polynucleotide comprising the nucleic acid sequence selected from the group consisting of SEQ ID NOs:18, 1-16, 19-50, 101-378, 657-672, 674-706, 716-719, 724-741, 755, 757-761 and 763.

According to an aspect of some embodiments of the present invention there is provided an isolated polynucleotide comprising a nucleic acid sequence capable of downregulating the expression level of a nucleic acid sequence at least 80% identical to SEQ ID NO:17 or 673.

According to an aspect of some embodiments of the present invention there is provided an isolated polynucleotide comprising a nucleic acid sequence capable of downregulating the expression level of the nucleic acid sequence set forth in SEQ ID NO:17 or 673.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NOs:68, 51-66, 69-100, 379-656, 707-715, 720-723, 742-754 and 764-772 with the proviso that the amino acid sequence is not as set forth by SEQ ID NO: 765 or 771.

According to an aspect of some embodiments of the present invention there is provided an isolated polynucleotide comprising a nucleic acid sequence encoding a polypeptide which comprises the amino acid sequence selected from the group consisting of SEQ ID NOs: 68, 51-66, 69-100, 379-656, 707-715, 720-723, 742-754, 764, 766-770 and 772.

According to an aspect of some embodiments of the present invention there is provided an isolated polynucleotide comprising a nucleic acid sequence capable of downregulating the expression level or activity of a polypeptide at least 80% homologous to the polypeptide set forth by SEQ ID NO:67.

According to an aspect of some embodiments of the present invention there is provided an isolated polynucleotide comprising a nucleic acid sequence capable of downregulating the expression level or activity of the polypeptide set forth by SEQ ID NO:67.

According to an aspect of some embodiments of the present invention there is provided a nucleic acid construct comprising the isolated polynucleotide of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO:68, 51-66, 69-100, 379-656, 707-715, 720-723, 742-754, 764-771 or 772 with the proviso that the amino acid sequence is not as set forth by SEQ ID NO:765 or 771.

According to an aspect of some embodiments of the present invention there is provided an isolated polypeptide comprising the amino acid sequence selected from the group consisting of SEQ ID NOs: 68, 51-66, 69-100, 379-656, 707-715, 720-723, 742-754, 764, 766-770 and 772.

According to an aspect of some embodiments of the present invention there is provided a nucleic acid construct comprising a nucleic acid sequence selected from the group consisting of SEQ ID NOs:779-792 and a heterologous polynucleotide sequence, wherein the nucleic acid sequence is capable of regulating expression of the heterologous polynucleotide in a host cell.

According to some embodiments of the invention, the heterologous polynucleotide is a reporter gene.

According to some embodiments of the invention, regulating the expression of the heterologous polynucleotide is in a tissue specific manner.

According to some embodiments of the invention, regulating the expression of the heterologous polynucleotide is in a developmental stage—specific manner.

According to some embodiments of the invention, the heterologous polynucleotide comprises a nucleic acid sequence at least 80% identical to the nucleic acid sequence selected from the group consisting of SEQ ID NOs:18, 1-16, 19-50, 101-378, 657-672, 674-706, 716-719, 724-741 and 755-763 with the proviso that the nucleic acid sequence is not as set forth by SEQ ID NO:756 or 762.

According to some embodiments of the invention, the heterologous polynucleotide encodes an amino acid sequence at least at least 80% homologous to SEQ ID NOs:68, 51-66, 69-100, 379-656, 707-715, 720-723, 742-754 and 764-772 with the proviso that the amino acid sequence is not as set forth by SEQ ID NO: 765 or 771.

According to an aspect of some embodiments of the present invention there is provided a method of increasing oil content, yield, growth rate, biomass, vigor, abiotic stress tolerance and/or nitrogen use efficiency of a plant comprising expressing within the plant the nucleic acid construct of claim 17, wherein the heterologous polynucleotide comprises a nucleic acid sequence at least 80% identical to SEQ ID NOs: 18, 1-16, 19-50, 101-378, 657-672, 674-706, 716-719, 724-741 and 755-763 with the proviso that the nucleic acid sequence is not as set forth by SEQ ID NO:756 or 762, thereby increasing the oil content, yield, growth rate, biomass, vigor, abiotic stress tolerance and/or nitrogen use efficiency of the plant.

According to an aspect of some embodiments of the present invention there is provided a method of increasing oil content, yield, growth rate, biomass, vigor, abiotic stress tolerance and/or nitrogen use efficiency of a plant comprising expressing within the plant the nucleic acid construct of claim 17, wherein the heterologous polynucleotide encodes an amino acid sequence at least at least 80% homologous to SEQ ID NOs:68, 51-66, 69-100, 379-656, 707-715, 720-723, 742-754 and 764-772 with the proviso that the amino acid sequence is not as set forth by SEQ ID NO: 765 or 771, thereby increasing the oil content, yield, growth rate, biomass, vigor, abiotic stress tolerance and/or nitrogen use efficiency of the plant.

According to an aspect of some embodiments of the present invention there is provided a plant cell exogenously expressing the polynucleotide of the invention, or the nucleic acid construct of the invention.

According to an aspect of some embodiments of the present invention there is provided a plant cell exogenously expressing the polypeptide of the invention.

According to some embodiments of the invention, the nucleic acid sequence is as set forth in SEQ ID NO:18, 1-16, 19-50, 101-378, 657-672, 674-706, 716-719, 724-741, 755, 757-761 or 763.

According to some embodiments of the invention, the polynucleotide consists of the nucleic acid sequence selected from the group consisting of SEQ ID NOs:18, 1-16, 19-50, 101-378, 657-672, 674-706, 716-719, 724-741, 755, 757-761 and 763.

According to some embodiments of the invention, the nucleic acid sequence encodes an amino acid sequence at least 80% homologous to SEQ ID NO:68, 51-66, 69-100, 379-656, 707-715, 720-723, 742-754, 764-771 or 772 with the proviso that the amino acid sequence is not as set forth by SEQ ID NO: 765 or 771.

According to some embodiments of the invention, the nucleic acid sequence encodes the amino acid sequence selected from the group consisting of SEQ ID NOs: 68, 51-66, 69-100, 379-656, 707-715, 720-723, 742-754, 764, 766-770 and 772.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, water deprivation, low temperature, high temperature, heavy metal toxicity, anaerobiosis, nutrient deficiency, nutrient excess, atmospheric pollution and UV irradiation.

According to some embodiments of the invention, the polynucleotide is a co-suppression polynucleotide, an antisense polynucleotide, an RNA-interference polynucleotide or a Ribozyme polynucleotide.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 1A-D are digital images of leaves depicting leaves parameters. FIG. 1A—leaf length (the leaf length is represented by the arrow); FIG. 1B—laminar length (the laminar length is represented by the arrow); FIG. 1C—laminar area (the laminar area is represented by the white ellipse); FIG. 1D—laminar width (the laminar width is represented by the arrow). Blade circularity was calculated as laminar width divided by laminar length.

FIG. 2A—An image of a photograph of plants taken following 12 days on agar plates. FIG. 2B—An image of root analysis in which the length of the root measured is represented by a red arrow.

DESCRIPTION OF SPECIFIC EMBODIMENTS OF THE INVENTION

Figures 2A, 2B:
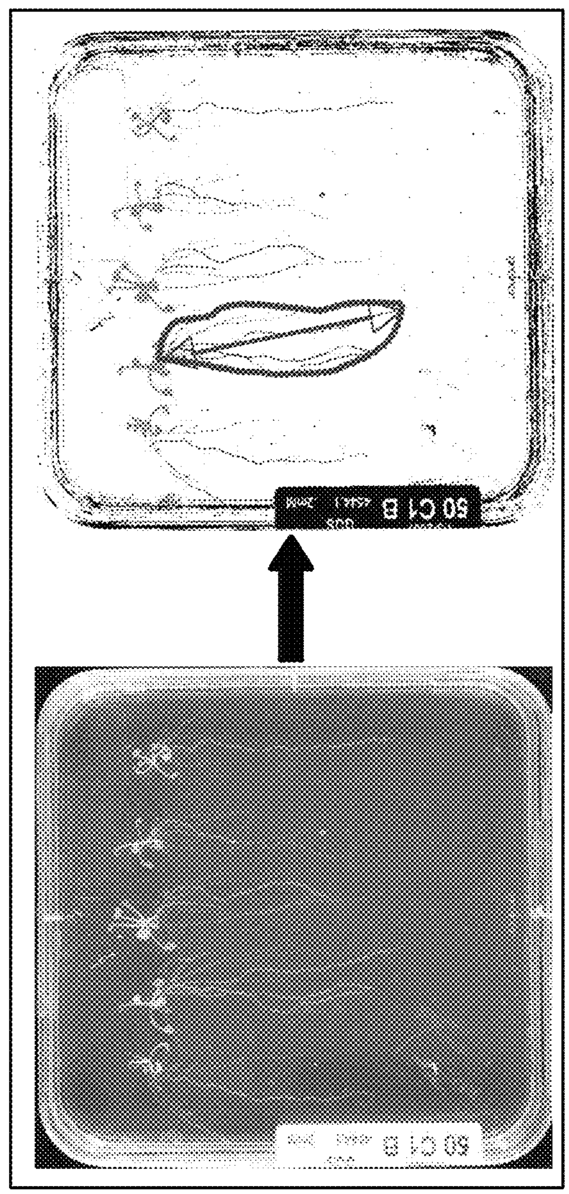
FIGS. 2A-B are images depicting visualization of root development of plants grown in transparent agar plates. The different transgenes were grown in transparent agar plates for 17 days and the plates were photographed every 2 days starting at day 7.

The present invention, in some embodiments thereof, relates to isolated polypeptides and polynucleotides encoding same, and more particularly, but not exclusively, to methods of using same for increasing oil content, growth rate, yield, biomass, vigor, abiotic stress tolerance and/or nitrogen use efficiency of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

While reducing the present invention to practice, the present inventors have identified novel polypeptides and polynucleotides which can be used to increase yield, growth rate, biomass, oil content, vigor, abiotic stress tolerance and/or nitrogen use efficiency of a plant.

Thus, as shown in the Examples section which follows, the present inventors have utilized bioinformatics tools to identify polynucleotides which enhance yield (e.g., seed yield, oil yield and oil content), growth rate, biomass, vigor, abiotic stress tolerance and/or nitrogen use efficiency of a plant. Genes which affect the trait-of-interest were identified based on expression profiles of genes of several Arabidopsis ecotypes and tissues, homology with genes known to affect the trait-of-interest and using digital expression profile in specific tissues and conditions (Tables 1, 3, 4, 5, 6, 7, 8, 9, 10 and 11, Examples 1 and 3). Homologous polypeptides and polynucleotides having the same function were also identified (Table 2, Example 2). Transgenic plants over-expressing the identified polynucleotides exhibit increased seed yield (e.g., weight of 1000 seeds), oil yield (e.g., oil percentage in seed), biomass (e.g., dry matter), harvest index, growth rate, rosette area, abiotic stress tolerance (e.g., to drought conditions) and nitrogen use efficiency (Tables 22, 23, 24, 25, 26 and 27; Examples 5 and 7; Tables 28-30, Example 8). In addition, the present inventors have uncovered that polynucleotides which reduce the expression level and/or activity of certain gene products (e.g., the BDL127 gene; SEQ ID NO:17 or 673) can increase yield (e.g., seed yield), biomass and/or growth rate in plants (Tables 31-36; Example 9). As is further shown in the Examples section which follows, the present inventors have uncovered novel promoter sequences which can be used to express the gene-of-interest in a tissue specific and/or developmental stage-specific manner (Tables 16, 17, 18, 19, 20 and 21, Example 6). Altogether, these results suggest the use of the polynucleotides or polypeptides of the invention for increasing yield, growth rate, biomass, vigor, abiotic stress tolerance and/or nitrogen use efficiency of a plant Thus, according to an aspect of some embodiments of the invention, there is provided method of increasing oil content, yield, growth rate, biomass, vigor, abiotic stress tolerance and/or nitrogen use efficiency of a plant, comprising expressing within the plant an exogenous polynucleotide comprising a nucleic acid sequence at least 80% identical to SEQ ID NOs:18, 1-16, 19-50, 101-378, 657-672, 674-706, 716-719, 724-741 and 755-763 with the proviso that the nucleic acid sequence is not as set forth by SEQ ID NO:756 or 762, thereby increasing the oil content, yield, growth rate, biomass, vigor, abiotic stress tolerance and/or nitrogen use efficiency of the plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant yield" refers to the amount (as determined by weight or size) or quantity (numbers) of tissue produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "plant biomass" refers to the amount (measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) result with improved field stand.

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

It should be noted that a plant yield can be determined under stress (e.g., abiotic stress, nitrogen-limiting conditions) or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), which enable normal metabolism, growth, reproduction and/or viability of a plant at any stage in its life cycle (from seed to mature plant and back to seed again). It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

As used herein the phrase "nitrogen use efficiency (NUE)" refers to the metabolic process(es) which lead to an increase in the plant's yield, biomass, vigor, growth rate and abiotic stress tolerance per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in oil content, yield, growth rate, biomass, vigor, abiotic stress tolerance and/or nitrogen use efficiency of a plant as compared to a native plant [i.e., a plant not modified with the biomolecules (polynucleotide or polypeptides) of the invention, e.g., a non-transformed plant of the same species which is grown under the same growth conditions).

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:18, 1-16, 19-50, 101-378, 657-672, 674-706, 716-719, 724-741 and 755-763 with the proviso that the nucleic acid sequence is not as set forth by SEQ ID NO:756 or 762.

Identity (e.g., percent homology) can be determined using any homology comparison software, including for example, the BlastN software of the National Center of Biotechnology Information (NCBI) such as by using default parameters.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:18, 1-16, 19-50, 101-378, 657-672, 674-706, 716-719, 724-741 and 755-763 with the proviso that the exogenous polynucleotide is not as set forth by SEQ ID NO:756 or 762.

According to some embodiments of the invention the exogenous polynucleotide is set forth by SEQ ID NO:18, 1-16, 19-50, 101-378, 657-672, 674-706, 716-719, 724-741, 755, 757-761 or 763.

In exemplary embodiments the exogenous polynucleotide is not the polynucleotide set forth by SEQ ID NO:807 or 808.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs:68, 51-66, 69-100, 379-656, 707-715, 720-723, 742-754 and 764-772 with the proviso that the amino acid sequence is not as set forth by SEQ ID NO: 765 or 771.

Homology (e.g., percent homology) can be determined using any homology comparison software, including for example, the BlastP or TBLASTN software of the National Center of Biotechnology Information (NCBI) such as by using default parameters, when starting from a polypeptide sequence; or the tBLASTX algorithm (available via the NCBI) such as by using default parameters, which compares the six-frame conceptual translation products of a nucleotide query sequence (both strands) against a protein sequence database.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: ncbi (dot) nlm (dot) nih (dot) gov. If orthologues in rice were sought, the sequence-of-interest would be blasted against, for example, the 28,469 full-length cDNA clones from *Oryza sativa* cv. Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [ebi (dot) ac (dot) uk/Tools/ clustalw2/index (dot) html], followed by a neighbor-joining tree (en (dot) wikipedia (dot) org/wiki/Neighbor-joining) which helps visualizing the clustering.

In an exemplary embodiment the exogenous polynucleotide does not encode a polypeptide having the amino acid sequence selected from the group consisting of SEQ ID NOs: 809-852.

According to some embodiments of the invention, the exogenous polynucleotide encodes a polypeptide consisting of the amino acid sequence set forth by SEQ ID NO: 68, 51-66, 69-100, 379-656, 707-715, 720-723, 742-754, 764, 766-770 or 772.

Nucleic acid sequences encoding the polypeptides of the present invention may be optimized for expression. Non-limiting examples of optimized nucleic acid sequences are provided in SEQ ID NOs:663 (BDL-113), 675 (BDL-129), 676 (BDL-130), 680 (BDL-134), 683 (BDL-137), 684 (BDL-139) and 685 (BDL-141) which encode optimized polypeptide comprising the amino acid sequences set forth by SEQ ID NOs:57, 69, 712, 74, 77, 78 and 79. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N[(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any *extra* statistical calculations, of codon optimization Tables such as those provided on-line at the Codon Usage Database through the NIAS (National Institute of Agrobiological Sciences) DNA bank in Japan (kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs:18, 1-16, 19-50, 101-378, 657-672, 674-706, 716-719, 724-741 and 755-763 with the proviso that the nucleic acid sequence is not as set forth by SEQ ID NO:756 or 762.

According to some embodiments of the invention the isolated polynucleotide comprising the nucleic acid sequence selected from the group consisting of SEQ ID NOs:18, 1-16, 19-50, 101-378, 657-672, 674-706, 716-719, 724-741, 755, 757-761 and 763.

According to some embodiments of the invention the isolated polynucleotide is set forth by SEQ ID NO:18, 1-16, 19-50, 101-378, 657-672, 674-706, 716-719, 724-741, 755, 757-761 or 763.

In exemplary embodiments the isolated polynucleotide is not the polynucleotide set forth by SEQ ID NO:807 or 808.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs:68, 51-66, 69-100, 379-656, 707-715, 720-723, 742-754 and 764-772 with the proviso that the amino acid sequence is not as set forth by SEQ ID NO: 765 or 771.

The invention provides an isolated polynucleotide comprising a nucleic acid sequence encoding a polypeptide which comprises the amino acid sequence selected from the group consisting of SEQ ID NOs:68, 51-66, 69-100, 379-656, 707-715, 720-723, 742-754, 764, 766-770 and 772.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs:68, 51-66, 69-100, 379-656, 707-715, 720-723, 742-754 and 764-772 with the proviso that the amino acid sequence is not as set forth by SEQ ID NO: 765 or 771.

In an exemplary embodiment the polypeptide is not the polypeptide set forth by SEQ ID NO: 809-851 or 852.

According to some embodiments of the invention, the polypeptide comprising an amino acid sequence selected from the group consisting of SEQ ID SEQ ID NOs:68, 51-66, 69-100, 379-656, 707-715, 720-723, 742-754, 764, 766-770 and 772.

According to some embodiments of the invention, the polypeptide is set forth by SEQ ID NO: 68, 51-66, 69-100, 379-656, 707-715, 720-723, 742-754, 764, 766-770 or 772.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorvcnium rectum, Echinochloa pyramidalis, Ehraffia* spp., *Eleusine coracana, Eragrestis* spp., *Erythrina* spp., *Eucalypfus* spp., *Euclea schimperi, Eulalia vi/losa, Pagopyrum* spp., *Feijoa sellowlana, Fragaria* spp., *Flemingia* spp, *Freycinetia banksli, Geranium thunbergii, GinAgo biloba, Glycine javanica, Gliricidia* spp, *Gossypium hirsutum, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

Expressing the exogenous polynucleotide of the invention within the plant can be effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

According to some embodiments of the invention, there is provided a nucleic acid construct comprising the isolated polynucleotide of the invention, and a promoter for directing transcription of the nucleic acid sequence in a host cell.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

Any suitable promoter sequence can be used by the nucleic acid construct of the present invention. Preferably the promoter is a constitutive promoter, a tissue-specific, or an abiotic stress-inducible promoter.

Suitable constitutive promoters include, for example, CaMV 35S promoter (SEQ ID NO:777; Odell et al., Nature 313:810-812, 1985); Arabidopsis At6669 promoter (SEQ ID NO:775; see PCT Publication No. WO04081173A2); maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (de Pater et al, Plant J November; 2(6):837-44, 1992); ubiquitin (Christensen et al, Plant Mol. Biol. 18: 675-689, 1992); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5.608,144; 5,604,121; 5.569,597: 5.466,785; 5,399,680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993], seed-preferred promoters [e.g., from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), Brazil Nut albumin (Pearson et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Mol Gen Genet 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Nati. Acad. Sci. USA, 93: 8117-8122), KNOX (Postma-Haarsma et al, Plant Mol. Biol. 39:257-71, 1999), rice oleosin (Wu et at, J. Biochem., 123: 386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217:240-245; 1989), apetala-3].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

As mentioned above, and further described in Example 6 of the Examples section which follows, the present inventors have uncovered novel promoter sequences (regulatory nucleic acid sequences) which can be used to express a polynucleotide-of-interest in a plant.

Thus, according to an aspect of some embodiments of the invention, there is provided a nucleic acid construct comprising a nucleic acid sequence selected from the group consisting of SEQ ID NOs:779-792 and a heterologous polynucleotide sequence, wherein the nucleic acid sequence is capable of regulating expression of the heterologous polynucleotide in a host cell.

According to some embodiments of the invention the heterologous polynucleotide is operably linked to the regulatory nucleic acid sequence selected from the group consisting of SEQ ID NOs:779-792.

According to some embodiments of the invention, the regulatory nucleic acid sequence of the invention range in length from about 500 nucleotides to about 4000 nucleotides and include one or more sequence regions which are capable of recognizing and binding RNA polymerase II and other proteins (trans-acting transcription factors) involved in transcription.

A coding nucleic acid sequence is "operably linked" to a regulatory sequence if the regulatory sequence is capable of exerting a regulatory effect on the coding sequence linked thereto. According to some embodiments of the invention, the regulatory sequence is positioned 1-500 bp upstream of the ATG codon of the coding nucleic acid sequence, although it will be appreciated that regulatory sequences can also exert their effect when positioned elsewhere with respect to the coding nucleic acid sequence (e.g., within an intron).

As is clearly illustrated in the Examples section which follows, the novel regulatory nucleic acid sequences of the invention are capable of regulating expression of a coding nucleic acid sequence (e.g., a reporter gene such as GUS, luciferase) operably linked thereto (see Example 6 of the Examples section which follows).

According to some embodiments of the invention, the regulatory nucleic acid sequences of the invention regulate the expression of the heterologous polynucleotide in a tissue specific manner.

According to some embodiments of the invention, the regulatory nucleic acid sequences of the invention regulate the expression of the heterologous polynucleotide in a developmental stage—specific manner.

According to some embodiments of the invention, the regulatory nucleic acid sequences of the invention are modified to create variations in the molecule sequences such as to enhance their promoting activities, using methods known in the art, such as PCR-based DNA modification, or standard DNA mutagenesis techniques, or by chemically synthesizing the modified polynucleotides.

Accordingly, the regulatory nucleic acid sequences set forth in SEQ ID NOs:779-792 may be truncated or deleted and still retain the capacity of directing the transcription of an operably linked heterologous DNA sequence. The minimal length of a promoter region can be determined by systematically removing sequences from the 5' and 3'-ends of the isolated polynucleotide by standard techniques known in the art, including but not limited to removal of restriction enzyme fragments or digestion with nucleases. Consequently, any sequence fragments, portions, or regions of the disclosed promoter polynucleotide sequences of the invention can be used as regulatory sequences. It will be appreciated that modified sequences (mutated, truncated and the like) can acquire different transcriptional properties such as the direction of different pattern of gene expression as compared to the unmodified element.

Optionally, the sequences set forth in SEQ ID NOs:779-792 may be modified, for example for expression in a range of plant systems. In another approach, novel hybrid promoters can be designed or engineered by a number of methods. Many promoters contain upstream sequences which activate, enhance or define the strength and/or specificity of the promoter, such as described, for example, by Atchison [Ann. Rev. Cell Biol. 4:127 (1988)]. T-DNA genes, for example contain "TATA" boxes defining the site of transcription initiation and other upstream elements located upstream of the transcription initiation site modulate transcription levels [Gelvin In: Transgenic Plants (Kung, S.-D. and Us, R., Eds, San Diego: Academic Press, pp. 49-87, (1988)]. Another chimeric promoter combined a trimer of the octopine synthase (OCS) activator to the mannopine synthase (mas) activator plus promoter and reported an increase in expression of a reporter gene [Min Ni et al. The Plant Journal 7:661 (1995)]. The upstream regulatory sequences of the promoter polynucleotide sequences of the invention can be used for the construction of such chimeric or hybrid promoters. Methods for construction of variant promoters include, but are not limited to, combining control elements of different promoters or duplicating portions or regions of a promoter (see for example, U.S. Pat. Nos. 5,110,732 and 5,097,025). Those of skill in the art are familiar with the specific conditions and procedures for the construction, manipulation and isolation of macromolecules (e.g., DNA molecules, plasmids, etc.), generation of recombinant organisms and the screening and isolation of genes, [see for example Sambrook et al., Molecular Cloning: A Laboratory Manual, Cold Spring Harbor Press, (1989); Mailga et al., Methods in Plant Molecular Biology, Cold Spring Harbor Press, (1995); Birren et al., Genome Analysis: volume 1, Analyzing DNA, (1997); volume 2, Detecting Genes, (1998); volume 3, Cloning Systems, (1999); and volume 4, Mapping Genomes, (1999), Cold Spring Harbor, N.Y].

According to some embodiments of the invention the heterologous polynucleotide which is regulated by the regulatory nucleic acid sequence of the invention (e.g., SEQ ID NO:779-791 or 792) comprises a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:18, 1-16, 19-50, 101-378, 657-672, 674-706, 716-719, 724-741 and 755-763 with the proviso that the nucleic acid sequence is not as set forth by SEQ ID NO:756 or 762.

According to some embodiments of the invention the heterologous polynucleotide encodes an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to SEQ ID NO:68, 51-66, 69-100, 379-656, 707-715, 720-723, 742-754, 764-771 or 772, with the proviso that the amino acid sequence is not as set forth by SEQ ID NO: 765 or 771.

According to some embodiments the heterologous polynucleotide does not encode the amino acid sequence set forth by SEQ ID NO: 809-851 or 852.

According to some embodiments the heterologous polynucleotide does not comprise the nucleic acid sequence set forth by SEQ ID NO:807 or 808.

Thus, according to some embodiments of the invention, the method of increasing oil content, yield, growth rate, biomass, vigor, abiotic stress tolerance and/or nitrogen use efficiency of a plant is effected by expressing within the plant a nucleic acid construct of the invention which comprises a nucleic acid sequence selected from the group consisting of SEQ ID NOs: 779-792 and a heterologous polynucleotide sequence which comprises a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NOs:18, 1-16, 19-50, 101-378, 657-672, 674-706, 716-719, 724-741 and 755-763 with the proviso that the nucleic acid sequence is not as set forth by SEQ ID NO:756 or 762, wherein the nucleic acid sequence is capable of regulating expression of the heterologous polynucleotide in a host cell.

According to some embodiments of the invention, the method of increasing oil content, yield, growth rate, biomass, vigor, abiotic stress tolerance and/or nitrogen use efficiency of a plant is effected by expressing within the plant a nucleic acid construct which comprises a nucleic acid sequence selected from the group consisting of SEQ ID NOs:779-792 and a heterologous polynucleotide sequence which encodes an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to SEQ ID NO:68, 51-66, 69-100, 379-656, 707-715, 720-723, 742-754, 764-771 or 772 with the proviso that the amino acid sequence is not as set forth by SEQ ID NO: 765 or 771, wherein the nucleic acid sequence is capable of regulating expression of the heterologous polynucleotide in a host cell.

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacemid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I. Annu. Rev. Plant. Physiol., Plant. Mol. Biol. (1991) 42:205-225; Shimamoto et al., Nature (1989) 338:274-276).

The principle methods of causing stable integration of exogenous DNA into plant genomic DNA include two main approaches:

(i) Agrobacterium-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The Agrobacterium system includes the use of plasmid vectors that contain defined DNA segments that integrate into the plant genomic DNA. Methods of inoculation of the plant tissue vary depending upon the plant species and the Agrobacterium delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the Agrobacterium delivery system in combination with vacuum infiltration. The Agrobacterium system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type Culture Collection (ATCC) or by isolation from infected plants. Isolation of viruses from infected plant tissues can be effected by techniques well known in the art such as described, for example by Foster and Tatlor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase oil content, yield, growth rate, biomass, vigor, abiotic stress tolerance and/or nitrogen use efficiency of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on oil content, yield, growth rate, biomass, vigor, abiotic stress tolerance and/or nitrogen use efficiency.

Expressing a plurality of exogenous polynucleotides in a single host plant can be effected by co-introducing multiple nucleic acid constructs, each including a different exogenous polynucleotide, into a single plant cell. The transformed cell can than be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, growth, biomass, yield, vigor and/or nitrogen use efficiency traits, using conventional plant breeding techniques.

As mentioned above, and further described in Example 9 of the Examples section which follows, the present inventors have uncovered that downregulating the expression level of the BDL127 gene product (e.g., the polynucleotides set forth by SEQ ID NO:17 or 673; or the polypeptide set forth by SEQ ID NO:67) and/or of homologous thereof can be used to increase yield (e.g., seed yield), oil content, biomass, growth rate, vigor, ABST and/or NUE in a plant.

In some cases, overexpression of the exogenous polynucleotide within the plant can result in silencing of the endogenous polynucleotide (which is homologous of the exogenous polynucleotide), probably through RNA interference or co-suppression mechanisms. To test the effect of downregulation of the polynucleotide(s) of the invention on the desired plant trait (e.g., plant yield, oil content, biomass, vigor, ABST or NUE), various downregulation methods and agents can be used.

Downregulation (gene silencing) of the transcription or translation product of an endogenous gene such as BDL127 can be achieved by methods which are well known in the art e.g., co-suppression, antisense suppression, RNA interference and ribozyme polynucleotide molecules, changing the promoter structure, removal or creation transcription factor binding sites or expression under different promoters. Guidelines for effecting same are provided infra.

Co-suppression (sense suppression)—Inhibition of the endogenous gene can be achieved by co-suppression, using an RNA molecule (or an expression vector encoding same) which is in the sense orientation with respect to the transcription direction of the endogenous gene. The polynucleotide used for co-suppression may correspond to all or part of the sequence encoding the endogenous polypeptide and/or to all or part of the 5' and/or 3' untranslated region of the endogenous transcript; it may also be an unpolyadenylated RNA; an RNA which lacks a 5' cap structure; or an RNA which contains an unsplicable intron. In some embodiments, the polynucleotide used for co-suppression is designed to eliminate the start codon of the endogenous polynucleotide so that no protein product will be translated. However, as with antisense suppression, the suppressive efficiency is enhanced as specificity of hybridization is increased, e.g., as the introduced sequence is lengthened, and/or as the sequence similarity between the introduced sequence and the endogenous gene is increased. For further details see U.S. Pat. Appl. Nos. 20050172364 and No. 5,231,020 which are fully incorporated herein by reference.

According to some embodiments of the invention, the exogenous polynucleotide comprises an untranslatable nucleic acid sequence, e.g., a sequence comprising one or more pre-mature stop codons, or nonsense mutations, such as described in U.S. Pat. No. 5,583,021.

According to some embodiments of the invention, downregulation of the endogenous gene is performed using an amplicon expression vector which comprises a plant virus-derived sequence that contains all or part of the target gene but generally not all of the genes of the native virus. The viral sequences present in the transcription product of the expression vector allow the transcription product to direct its own replication. The transcripts produced by the amplicon may be either sense or antisense relative to the target sequence [see for example, Angell and Baulcombe, (1997) *EMBO J.* 16:3675-3684; Angell and Baulcombe, (1999) *Plant J.* 20:357-362, and U.S. Pat. No. 6,646,805, each of which is herein incorporated by reference].

According to some embodiments of the invention, the exogenous polynucleotide comprises an untranslatable nucleic acid sequence, e.g., a sequence comprising one or more pre-mature stop codons, or nonsense mutations, such as described in U.S. Pat. No. 5,583,021.

Antisense suppression—Antisense suppression can be performed using an antisense polynucleotide or an expression vector which is designed to express an RNA molecule complementary to all or part of the messenger RNA (mRNA) encoding the endogenous polypeptide and/or to all or part of the 5' and/or 3' untranslated region of the endogenous gene. Over expression of the antisense RNA molecule can result in reduced expression of the native (endogenous) gene. The antisense polynucleotide may be fully complementary to the target sequence (i.e., 100% identical to the complement of the target sequence) or partially complementary to the target sequence (i.e., less than 100% identical, e.g., less than 90%, less than 80% identical to the complement of the target sequence). Antisense suppression may be used to inhibit the expression of multiple proteins in the same plant (see e.g., U.S. Pat. No. 5,942,657). In addition, portions of the antisense nucleotides may be used to disrupt the expression of the target gene. Generally, sequences of at least about 50 nucleotides, at least about 100 nucleotides, at least about 200 nucleotides, at least about 300, at least about 400, at least about 450, at least about 500, at least about 550, or greater may be used. Methods of using antisense suppression to inhibit the expression of endogenous genes in plants are described, for example, in Liu, et al., (2002) Plant Physiol. 129:1732-1743 and U.S. Pat. Nos. 5,759,829 and 5,942,657, each of which is herein incorporated by reference. Efficiency of antisense suppression may be increased by including a poly-dT region in the expression cassette at a position 3' to the antisense sequence and 5' of the polyadenylation signal [See, U.S. Patent Publication No. 20020048814, herein incorporated by reference].

RNA interference—RNA interference can be achieved using a polynucleotide, which can anneal to itself and form a double stranded RNA having a stem-loop structure (also called hairpin structure), or using two polynucleotides, which form a double stranded RNA.

For hairpin RNA (hpRNA) interference, the expression vector is designed to express an RNA molecule that hybridizes to itself to form a hairpin structure that comprises a single-stranded loop region and a base-paired stem.

In some embodiments of the invention, the base-paired stem region of the hpRNA molecule determines the specificity of the RNA interference. In this configuration, the sense sequence of the base-paired stem region may correspond to all or part of the endogenous mRNA to be downregulated, or to a portion of a promoter sequence controlling expression of the endogenous gene to be inhibited; and the antisense sequence of the base-paired stem region is fully or partially complementary to the sense sequence. Such hpRNA molecules are highly efficient at inhibiting the expression of endogenous genes, in a manner which is inherited by subsequent generations of plants [See, e.g., Chuang and Meyerowitz, (2000) Proc. Natl. Acad. Sci. USA 97:4985-4990; Stoutjesdijk, et al., (2002) Plant Physiol. 129:1723-1731; and Waterhouse and Helliwell, (2003) Nat. Rev. Genet. 4:29-38; Chuang and Meyerowitz, (2000) Proc. Natl. Acad. Sci. USA 97:4985-4990; Pandolfini et al., BMC Biotechnology 3:7; Panstruga, et al., (2003) Mol. Biol. Rep. 30:135-140; and U.S. Patent Publication No. 2003/0175965; each of which is incorporated by reference].

According to some embodiments of the invention, the sense sequence of the base-paired stem is from about 10 nucleotides to about 2,500 nucleotides in length, e.g., from about 10 nucleotides to about 500 nucleotides, e.g., from about 15 nucleotides to about 300 nucleotides, e.g., from about 20 nucleotides to about 100 nucleotides, e.g., or from about 25 nucleotides to about 100 nucleotides.

According to some embodiments of the invention, the antisense sequence of the base-paired stem may have a length that is shorter, the same as, or longer than the length of the corresponding sense sequence.

According to some embodiments of the invention, the loop portion of the hpRNA can be from about 10 nucleotides to about 500 nucleotides in length, for example from about 15 nucleotides to about 100 nucleotides, from about 20 nucleotides to about 300 nucleotides or from about 25 nucleotides to about 400 nucleotides in length.

According to some embodiments of the invention, the loop portion of the hpRNA can include an intron (ihpRNA), which is capable of being spliced in the host cell. The use of an intron minimizes the size of the loop in the hairpin RNA molecule following splicing and thus increases efficiency of the interference [See, for example, Smith, et al., (2000) Nature 407: 319-320; Wesley, et al., (2001) Plant J. 27:581-590; Wang and Waterhouse, (2001) Curr. Opin. Plant Biol. 5:146-150; Helliwell and Waterhouse, (2003) Methods 30:289-295; Brummell, et al. (2003) Plant J. 33:793-800; and U.S. Patent Publication No. 2003/0180945; WO 98/53083; WO 99/32619; WO 98/36083; WO 99/53050; US 20040214330; US 20030180945; U.S. Pat. No. 5,034,323; U.S. Pat. No. 6,452,067; U.S. Pat. No. 6,777,588; U.S. Pat. No. 6,573,099 and U.S. Pat. No. 6,326,527; each of which is herein incorporated by reference].

In some embodiments of the invention, the loop region of the hairpin RNA determines the specificity of the RNA interference to its target endogenous RNA. In this configuration, the loop sequence corresponds to all or part of the endogenous messenger RNA of the target gene. See, for example, WO 02/00904; Mette, et al., (2000) EMBO J 19:5194-5201; Matzke, et al., (2001) Curr. Opin. Genet. Devel. 11:221-227; Scheid, et al., (2002) Proc. Natl. Acad. Sci., USA 99:13659-13662; Aufsaftz, et al., (2002) Proc. Nat'l. Acad. Sci. 99(4): 16499-16506; Sijen, et al., Curr. Biol. (2001) 11:436-440), each of which is incorporated herein by reference.

For double-stranded RNA (dsRNA) interference, the sense and antisense RNA molecules can be expressed in the same cell from a single expression vector (which comprises sequences of both strands) or from two expression vectors (each comprising the sequence of one of the strands). Methods for using dsRNA interference to inhibit the expression of endogenous plant genes are described in Waterhouse, et al., (1998) Proc. Natl. Acad. Sci. USA 95:13959-13964; and WO 99/49029, WO 99/53050, WO 99/61631, and WO 00/49035; each of which is herein incorporated by reference.

According to some embodiments of the invention, RNA interference is effected using an expression vector designed to express an RNA molecule that is modeled on an endogenous micro RNAs (miRNA) gene. Micro RNAs (miRNAs) are regulatory agents consisting of about 22 ribonucleotides and highly efficient at inhibiting the expression of endogenous genes [Javier, et al., (2003) Nature 425:257-263]. The miRNA gene encodes an RNA that forms a hairpin structure containing a 22-nucleotide sequence that is complementary to the endogenous target gene.

Ribozyme—Catalytic RNA molecules, ribozymes, are designed to cleave particular mRNA transcripts, thus preventing expression of their encoded polypeptides. Ribozymes cleave mRNA at site-specific recognition sequences. For example, "hammerhead ribozymes" (see, for example, U.S. Pat. No. 5,254,678) cleave mRNAs at locations dictated by flanking regions that form complementary base pairs with the target mRNA. The sole requirement is that the target RNA contains a 5'-UG-3' nucleotide sequence. Hammerhead ribozyme sequences can be embedded in a stable RNA such as a transfer RNA (tRNA) to increase cleavage efficiency in vivo [Perriman et al. (1995) Proc. Natl. Acad. Sci. USA, 92(13):6175-6179; de Feyter and Gaudron Methods in Molecular Biology, Vol. 74, Chapter 43, "Expressing Ribozymes in Plants", Edited by Turner, P. C, Humana Press Inc., Totowa, N.J.; U.S. Pat. No. 6,423,885]. RNA endoribonucleases such as that found in Tetrahymena thermophila are also useful ribozymes (U.S. Pat. No. 4,987,071).

Plant lines transformed with any of the downregulating molecules described hereinabove are screened to identify those that show the greatest inhibition of the endogenous polynucleotide or polypeptide-of-interest, and thereby the increase of the desired plant trait (e.g., yield, oil content, growth rate, biomass, vigor, NUE and/or ABST).

Thus, the invention encompasses plants exogenously expressing the polynucleotide(s), the nucleic acid constructs and/or polypeptide(s) of the invention. Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked ImmunoSorbent Assay (ELISA), radio-immuno-assays (RIA), immunohistochemistry, immunocytochemistry, immunofluorescence and the like.

The level of an RNA molecule-of interest in the plant [e.g., the RNA transcribed from the exogenous polynucleotide of the invention or the endogenous RNA which is targeted by the downregulating molecule of the invention] can be determined using methods well known in the art such as Northern blot analysis, reverse transcription polymerase chain reaction (RT-PCR) analysis (including quantitative, semi-quantitative or real-time RT-PCR) and RNA-in situ hybridization.

The endogenous homolog of the exogenous polynucleotide or polypeptide of the invention, or a fragment of the endogenous homolog (e.g. introns or untranslated regions) in the plant can be used as a marker for marker assisted selection (MAS), in which a marker is used for indirect selection of a genetic determinant or determinants of a trait of interest (e.g., biomass, growth rate, oil content, yield, abiotic stress tolerance and/or nitrogen use efficiency). These genes (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

The effect of the transgene (the exogenous polynucleotide encoding the polypeptide of the invention) or the downregulating molecule (e.g., RNA-interference molecule) on abiotic stress tolerance can be determined using known methods.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants. Quantitative parameters of tolerance measured include, but are not limited to, the average wet and dry weight, the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/osmoticum assay—Tolerance to drought is performed to identify the genes conferring better plant survival after acute water deprivation. To analyze whether the transgenic plants are more tolerant to drought, an osmotic stress produced by the presence of sorbitol or polyethylene glycol (PEG 8000) in the medium is performed. Control and transgenic plants are germinated and grown in plant-agar plates for 10 days, after which they are transferred to plates containing 1.5% PEG8000 or 500 mM of sorbitol. Plants are grown for about additional 10 days. The treatment causes growth retardation, then both control and transgenic plants are compared, by measuring plant weight (fresh and dry), yield, and by growth rates.

Conversely, soil-based drought screens are performed with plants overexpressing the polynucleotides detailed above. Seeds from control Arabidopsis plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene (the exogenous polynucleotide encoding the polypeptide of the invention) or the downregulating molecule (e.g., RNA-interference molecule) on nitrogen use efficiency can be determined using known methods.

Nitrogen use efficiency assay using plantlets—Briefly, transgenic plants which are grown for 7-10 days in 0.5×MS [Murashige-Skoog] supplemented with a selection agent are transferred to two nitrogen fertilization conditions: MS media in which the combined nitrogen concentration ($NH_4NO_3$ and $KNO_3$) was 0.75 mM (nitrogen deficiency). Usually, 20 randomly selected plants from each event of a gene are transferred to the media. Plants are allowed to grow for additional 10 days. At the end of the 10 days plants are removed from the plate and immediately weighed (fresh weight) and then dried for 24 and re-weight (dry weight for later statistical analysis). Transgenic plants are compared to control plants grown in parallel under the same conditions. Mock-transgenic plants used as control can be those transgenic plants expressing the uidA reporter gene (GUS) under the same promoter or transgenic plants harboring only the same promoter but lacking any reporter gene.

Grain protein concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

The effect of the transgene (the exogenous polynucleotide encoding the polypeptide of the invention) or the downregulating molecule (e.g., RNA-interference molecule) on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative growth area can be calculated using Formula I.

$$\text{Relative growth area rate}=(\Delta\text{Area}/\Delta t)*(1/\text{Area}\,t0) \qquad \text{Formula I}$$

Δt is the current analyzed image day subtracted from the initial day (t−t0).

Thus, the relative growth area rate is in units of 1/day and length growth rate is in units of 1/day.

Seed yield—Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants.

Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula II:

1000 Seed Weight=number of seed in sample/sample weight×1000 Formula II

The Harvest Index can be calculated using Formula III

Harvest Index=Average seed yield per plant/Average dry weight Formula III

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (cottoninc (dot) com/Classification-ofCotton/?Pg=4#Length).

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods. According to some embodiments of the invention, the oil comprises a seed oil.

According to some embodiments of the invention, the oil comprises a vegetative portion oil.

According to some embodiments of the invention, the plant cell forms a part of a plant.

As used herein the term "about" refers to ±10%.

The terms "comprises", "comprising", "includes", "including", "having" and their conjugates mean "including but not limited to".

The term "consisting of means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible sub-ranges as well as individual numerical values within that range. For example, description of a range such as from 1 to 6 should be considered to have specifically disclosed sub-ranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Gene Identification and Gene Role Prediction Using Bioinformatics Tools

The present inventors have identified polynucleotides which can increase plant yield, seed yield, oil yield, oil content, biomass, growth rate, abiotic stress tolerance, nitrogen use efficiency and/or vigor of a plant, as follows.

The nucleotide sequence datasets used here were from publicly available databases or from sequences obtained using the Solexa technology (e.g. Barley and Sorghum). Sequence data from 100 different plant species was introduced into a single, comprehensive database. Other information on gene expression, protein annotation, enzymes and pathways were also incorporated. Major databases used include:

Genomes

Arabidopsis genome [TAIR genome version 6 (arabidopsis (dot) org/)];

Rice genome [IRGSP build 4.0 (rgp (dot) dna (dot) affrc (dot) go (dot) jp/IRGSP/)];

Poplar [Populus trichocarpa release 1.1 from JGI (assembly release v1.0) (genome (dot) jgi-psf (dot) org/)];

Brachypodium [JGI 4× assembly, brachpodium (dot) org)];

Soybean [DOE-JGI SCP, version Glyma0 (phytozome (dot) net/)];

Grape [French-Italian Public Consortium for Grapevine Genome Characterization grapevine genome (genoscope (dot) cns (dot) fr/)];

Castorbean [TIGR/J Craig Venter Institute 4× assembly [jcvi (dot) org/r_communis];

Sorghum [DOE-JGI SCP, version Sbi1 [phytozome (dot) net/)];

Partially assembled genome of Maize [maizesequence (dot) org/];

Expressed EST and mRNA Sequences were Extracted from the Following Databases:

GenBank versions 154, 157, 160, 161, 164, 165, 166 and 168 (ncbi (dot) nlm (dot) nih (dot) gov/dbEST/);

RefSeq (ncbi (dot) nlm (dot) nih (dot) gov/RefSeq/);

TAIR (arabidopsis (dot) org/);

Protein and Pathway Databases

Uniprot [uniprot (dot) org/].

AraCyc [arabidopsis (dot) org/biocyc/index (dot) jsp].

ENZYME [expasy (dot) org/enzyme/].

Microarray Datasets were Downloaded from:

GEO (ncbi (dot) nlm (dot) nih (dot) gov/geo/)

TAIR (arabidopsis (dot) org/).

Proprietary Evogene's microarray data (See WO2008/122980 to Evogene and Example 3 below.

QTL and SNPs Information

Gramene [gramene (dot) org/qtl/].

Panzea [panzea (dot) org/index (dot) html].

Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (arabidopsis, rice, castorbean, grape, brachypodium, poplar, soybean, sorghum) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows: Blast search [blast (dot) ncbi (dot) nlm (dot) nih (dot) gov/Blast (dot) cgi] against all plant UniProt [uniprot (dot) org/] sequences was performed. Open reading frames of each putative transcript were analyzed and longest ORF with higher number of homologues was selected as predicted protein of the transcript. The predicted proteins were analyzed by InterPro [ebi (dot) ac (dot) uk/interpro/].

Blast against proteins from AraCyc and ENZYME databases was used to map the predicted transcripts to AraCyc pathways.

Predicted proteins from different species were compared using blast algorithm [ncbi (dot) nlm (dot) nih (dot) gov/Blast (dot) cgi] to validate the accuracy of the predicted protein sequence, and for efficient detection of orthologs.

Gene expression profiling—Several data sources were exploited for gene expression profiling which combined microarray data and digital expression profile (see below). According to gene expression profile, a correlation analysis was performed to identify genes which are co-regulated under different developmental stages and environmental conditions and which are associated with different phenotypes.

Publicly available microarray datasets were downloaded from TAIR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags that assembled into 67,477 unigenes (32,357 singletons and 35,120 contigs). Analysis of the data obtained against the Cucurbit Genomics Database [icugi (dot) org/] confirmed the accuracy of the sequencing and assembly. Expression patterns of selected genes fitted well their qRT-PCR data.

The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To identify putative orthologs of the genes affecting plant yield, oil yield, oil content, seed yield, growth rate, vigor, biomass, abiotic stress tolerance and/or nitrogen use efficiency, all sequences were aligned using the BLAST (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly. Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

Overall, 50 genes were identified to have a major impact on plant yield, seed yield, oil yield, oil content, biomass, growth rate, vigor, abiotic stress tolerance (ABST) and/or nitrogen use efficiency (NUE) when expressed in a plant. The identified genes, their curated polynucleotide and polypeptide sequences, as well as their updated sequences according to Genbank database are provided in Table 1, hereinbelow.

TABLE 1

Identified polynucleotides which affect plant yield, seed yield, oil yield, oil content, biomass, growth rate, vigor, abiotic stress tolerance and/or nitrogen use efficiency of a plant

| Gene Name | Cluster Name | Organism | Polynucleotide SEQ ID NO: | Polypeptide SEQ ID NO: |
|---|---|---|---|---|
| BDL100 | rice\|gb157.2\|BI812936 | rice | 1 | 51 |
| BDL100 | | | 1 | 723 |
| BDL106 | canola\|gb161\|DY020650 | canola | 2 | 52 |
| BDL106 | | | 724 | 52 |
| BDL108 | canola\|gb161\|CD818601 | canola | 3 | 53 |
| BDL108 | | | 725 | 742 |
| BDL108 | | | 726 | 743 |
| BDL110 | canola\|gb161\|CD814521 | canola | 4 | 54 |
| BDL110 | | | 727 | 744 |
| BDL110 | | | 728 | 745 |
| BDL111 | canola\|gb161\|CN829852 | canola | 5 | 55 |
| BDL111 | | | 729 | 746 |
| BDL111 | | | 730 | 747 |
| BDL112 | arabidopsis\|gb165\|AT3G23510 | *arabidopsis* | 6 | 56 |
| BDL113 | arabidopsis\|gb165\|AT2G45310 | *arabidopsis* | 7 | 57 |
| BDL114 | arabidopsis\|gb165\|AT5G27820 | *arabidopsis* | 8 | 58 |
| BDL115 | arabidopsis\|gb165\|AT4G11090 | *arabidopsis* | 9 | 59 |
| BDL116 | arabidopsis\|gb165\|AT4G24175 | *arabidopsis* | 10 | 60 |
| BDL119 | arabidopsis\|gb165\|AT3G47965 | *arabidopsis* | 11 | 61 |
| BDL119 | | | 731 | 748 |
| BDL120 | arabidopsis\|gb165\|AT3G03230 | *arabidopsis* | 12 | 62 |
| BDL120 | | | 732 | 749 |
| BDL122 | arabidopsis\|gb165\|AT3G49000 | *arabidopsis* | 13 | 63 |
| BDL123 | arabidopsis\|gb165\|AT2G21860 | *arabidopsis* | 14 | 64 |
| BDL124 | arabidopsis\|gb165\|AT5G51590 | *arabidopsis* | 15 | 65 |
| BDL124 | | | 733 | 750 |
| BDL125 | arabidopsis\|gb165\|AT3G16180 | *arabidopsis* | 16 | 66 |
| BDL125 | | | 734 | 751 |
| BDL127 | arabidopsis\|gb165\|AT3G44940 | *arabidopsis* | 17 | 67 |
| BDL128 | arabidopsis\|gb165\|AT1G60770 | *arabidopsis* | 18 | 68 |
| BDL129 | arabidopsis\|gb165\|AT4G08690 | *arabidopsis* | 19 | 69 |
| BDL129 | | | 735 | 69 |
| BDL130 | arabidopsis\|gb165\|AT3G03870 | *arabidopsis* | 20 | 70 |
| BDL130 | | | 736 | 752 |
| BDL131 | arabidopsis\|gb165\|AT4G27450 | *arabidopsis* | 21 | 71 |
| BDL131 | | | 737 | 71 |
| BDL132 | arabidopsis\|gb165\|AT4G23730 | *arabidopsis* | 22 | 72 |
| BDL133 | arabidopsis\|gb165\|AT3G06150 | *arabidopsis* | 23 | 73 |
| BDL134 | arabidopsis\|gb165\|AT3G28420 | *arabidopsis* | 24 | 74 |
| BDL134 | | | 738 | 753 |
| BDL135 | arabidopsis\|gb165\|AT3G18600 | *arabidopsis* | 25 | 75 |
| BDL136 | arabidopsis\|gb165\|AT3G22990 | *arabidopsis* | 26 | 76 |
| BDL137 | arabidopsis\|gb165\|AT5G14530 | *arabidopsis* | 27 | 77 |
| BDL139 | arabidopsis\|gb165\|AT1G29800 | *arabidopsis* | 28 | 78 |
| BDL141 | arabidopsis\|gb165\|AT1G29980 | *arabidopsis* | 29 | 79 |
| BDL142 | arabidopsis\|gb165\|AT2G39110 | *arabidopsis* | 30 | 80 |
| BDL142 | | | 30 | 754 |
| BDL143 | arabidopsis\|gb165\|AT1G62810 | *arabidopsis* | 31 | 81 |
| BDL143 | | | 739 | 81 |
| BDL144 | arabidopsis\|gb165\|AT3G14890 | *arabidopsis* | 32 | 82 |
| BDL145 | arabidopsis\|gb165\|AT1G24470 | *arabidopsis* | 33 | 83 |
| BDL145 | | | 740 | 83 |
| BDL146 | arabidopsis\|gb165\|AT3G09310 | *arabidopsis* | 34 | 84 |
| BDL146 | | | 741 | 84 |
| BDL148 | arabidopsis\|gb165\|AT4G35785 | *arabidopsis* | 35 | 85 |
| BDL42 | arabidopsis\|gb165\|AT5G13170 | *arabidopsis* | 36 | 86 |
| BDL46 | arabidopsis\|gb165\|AT2G13690 | *arabidopsis* | 37 | 87 |
| BDL46 | | | 719 | 87 |
| BDL51 | arabidopsis\|gb165\|AT5G64260 | *arabidopsis* | 38 | 88 |
| BDL52 | tomato\|gb164\|BG127438 | tomato | 39 | 89 |
| BDL52 | | | 716 | 89 |
| BDL54 | arabidopsis\|gb165\|AT2G41090 | *arabidopsis* | 40 | 90 |
| BDL56 | arabidopsis\|gb165\|AT2G32990 | *arabidopsis* | 41 | 91 |
| BDL59 | arabidopsis\|gb165\|AT5G07110 | *arabidopsis* | 42 | 92 |
| BDL59 | | | 717 | 92 |
| BDL60 | arabidopsis\|gb165\|AT2G45200 | *arabidopsis* | 43 | 93 |
| BDL65 | arabidopsis\|gb165\|AT4G20360 | *arabidopsis* | 44 | 94 |
| BDL67 | arabidopsis\|gb165\|AT1G73600 | *arabidopsis* | 45 | 95 |
| BDL68 | arabidopsis\|gb165\|AT2G17280 | *arabidopsis* | 46 | 96 |
| BDL78 | arabidopsis\|gb165\|AT3G26520 | *arabidopsis* | 47 | 97 |
| BDL78 | | | 718 | 720 |
| BDL82 | arabidopsis\|gb165\|AT1G21790 | *arabidopsis* | 48 | 98 |
| BDL89 | rice\|gb157.2\|AA749665 | rice | 49 | 99 |

TABLE 1-continued

Identified polynucleotides which affect plant yield, seed yield, oil yield, oil content, biomass, growth rate, vigor, abiotic stress tolerance and/or nitrogen use efficiency of a plant

| Gene Name | Cluster Name | Organism | Polynucleotide SEQ ID NO: | Polypeptide SEQ ID NO: |
|---|---|---|---|---|
| BDL89 | | | 49 | 721 |
| BDL95 | rice\|gb157.2\|AU062876 | rice | 50 | 100 |
| BDL95 | | | 50 | 722 |

Table 1: Provided are the identified genes, their annotation, organism and polynucleotide and polypeptide sequence identifiers.
Note that SEQ ID NOs: 716-719 and 724-741 are variants of the identified polynucleotides and SEQ ID NOs: 720-723 and 742-754 are variants of the identified polypeptides.

Example 2

Identification of Homologous Sequences that Increase Seed Yield, Oil Yield, Growth Rate, Oil Content, Biomass, Vigor, ABST and/or NUE of a Plant The search and identification of homologous genes involves the screening of sequence information available, for example, in public databases such as the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium* spp.), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (biochem (dot) ucl (dot) ac (dot) uk/bsm/dbbrowser/protocol/prodomqry (dot) html), PIR (pir (dot) Georgetown (dot) edu/) or Pfam (sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Genes identified in publicly available sequence databases as sharing high sequence homology to the arabidopsis genes identified herein are summarized in Table 2 below. Those genes are expected to increase plant yield, seed yield, oil yield, oil content, growth rate, biomass, vigor, ABST and/or NUE of a plant have been identified from the databases using BLAST software (BLASTP and TBLASTN) and are provided in Table 2, hereinbelow.

TABLE 2

| Polynuc. SEQ ID NO: | Cluster name | Organism | Polypept. SEQ ID NO: | Homology to SEQ ID NO: | % identity | Algorithm |
|---|---|---|---|---|---|---|
| | Homologous polynucleotides and polypeptides | | | | | |
| 101 | brachypodium\|gb169\|BE415618 | *brachypodium* | 379 | 51 | 88.81 | blastp |
| 102 | maize\|gb169.2\|AI600710 | maize | 380 | 51 | 90.11 | blastp |
| 103 | maize\|gb169.2\|AI615263 | maize | 381 | 51 | 91.09 | blastp |
| 104 | sorghum\|gb161.crp\|AI987481 | *sorghum* | 382 | 51 | 81.43 | blastp |
| 105 | sugarcane\|gb157.3\|CA081111 | sugarcane | 383 | 51 | 86.03 | blastp |
| 106 | switchgrass\|gb167\|FE601953 | switchgrass | 384 | 51 | 90.99 | blastp |
| 107 | wheat\|gb164\|BE490052 | wheat | 385 | 51 | 89.72 | blastp |
| 108 | b_rapa\|gb162\|EX108797 | b_rapa | 386 | 52 | 80 | tblastn |
| 109 | b_rapa\|gb162\|EX138742 | b_rapa | 387 | 52 | 92.86 | blastp |
| 110 | canola\|gb161\|CD821478 | canola | 388 | 52 | 80 | tblastn |
| 111 | radish\|gb164\|EV569061 | radish | 389 | 52 | 83.1 | tblastn |
| 112 | antirrhinum\|gb166\|AJ558675 | *antirrhinum* | 390 | 53 | 80.77 | blastp |
| 113 | apple\|gb157.3\|CN580529 | apple | 391 | 53 | 80.22 | blastp |
| 114 | arabidopsis\|gb165\|AT5G15750 | *arabidopsis* | 392 | 53 | 88.46 | blastp |
| 115 | b_rapa\|gb162\|CX270798 | b_rapa | 393 | 53 | 93.41 | blastp |
| 116 | b_rapa\|gb162\|DY009670 | b_rapa | 394 | 53 | 99.45 | blastp |
| 117 | bean\|gb167\|CA897445 | bean | 395 | 53 | 84.07 | blastp |
| 118 | cacao\|gb167\|CU485233 | *cacao* | 396 | 53 | 84.07 | blastp |
| 119 | canola\|gb161\|EE456125 | canola | 397 | 53 | 91.21 | blastp |
| 120 | centaurea\|gb166\|EH737065 | *centaurea* | 398 | 53 | 80.22 | blastp |
| 121 | citrus\|gb166\|CB304606 | *citrus* | 399 | 53 | 82.97 | blastp |
| 122 | cotton\|gb164\|BQ409188 | cotton | 400 | 53 | 86.26 | blastp |
| 123 | cowpea\|gb166\|FF400239 | cowpea | 401 | 53 | 82.97 | blastp |
| 124 | cynara\|gb167\|GE592319 | *cynara* | 402 | 53 | 81.32 | blastp |
| 125 | dandelion\|gb161\|DY824742 | dandelion | 403 | 53 | 81.87 | tblastn |
| 126 | grape\|gb160\|CA813426 | grape | 404 | 53 | 84.07 | blastp |
| 127 | ipomoea\|gb157.2\|CJ749317 | *ipomoea* | 405 | 53 | 83.06 | blastp |
| 128 | kiwi\|gb166\|FG473358 | kiwi | 406 | 53 | 82.42 | blastp |
| 129 | lettuce\|gb157.2\|DW152666 | lettuce | 407 | 53 | 80.77 | blastp |
| 130 | melon\|gb165\|EB714755 | melon | 408 | 53 | 80.22 | tblastn |
| 131 | radish\|gb164\|EV526240 | radish | 409 | 53 | 95.63 | blastp |
| 132 | radish\|gb164\|EV537766 | radish | 410 | 53 | 95.63 | blastp |
| 133 | soybean\|gb168\|BE202985 | soybean | 411 | 53 | 83.52 | blastp |
| 134 | soybean\|gb168\|BM139685 | soybean | 412 | 53 | 83.52 | blastp |
| 135 | sunflower\|gb162\|CD851096 | sunflower | 413 | 53 | 82.97 | blastp |
| 136 | thellungiella\|gb167\|BY810244 | *thellungiella* | 414 | 53 | 91.21 | tblastn |
| 137 | triphysaria\|gb164\|BM356672 | *triphysaria* | 415 | 53 | 81.87 | blastp |
| 138 | arabidopsis\|gb165\|AT1G21760 | *arabidopsis* | 416 | 54 | 92.38 | blastp |
| 139 | b_oleracea\|gb161\|AM059122 | b_oleracea | 417 | 54 | 99.39 | blastp |
| 140 | b_rapa\|gb162\|DN965363 | b_rapa | 418 | 54 | 86.06 | blastp |
| 141 | cotton\|gb164\|CO083170 | cotton | 419 | 54 | 80.06 | tblastn |
| 142 | peanut\|gb167\|ES716655 | peanut | 420 | 54 | 80.06 | blastp |
| 143 | radish\|gb164\|EV546747 | radish | 421 | 54 | 99.39 | blastp |
| 144 | soybean\|gb168\|AI967832 | soybean | 422 | 54 | 80.66 | blastp |
| 145 | soybean\|gb168\|AW395758 | soybean | 423 | 54 | 80.97 | blastp |
| 146 | arabidopsis\|gb165\|AT3G23530 | *arabidopsis* | 424 | 56 | 96.89 | blastp |
| 147 | arabidopsis\|gb165\|AT1G02000 | *arabidopsis* | 425 | 57 | 82.31 | blastp |
| 148 | arabidopsis\|gb165\|AT2G45315 | *arabidopsis* | 426 | 57 | 86.5 | tblastn |
| 149 | arabidopsis\|gb165\|AT4G00110 | *arabidopsis* | 427 | 57 | 83.07 | blastp |
| 150 | b_rapa\|gb162\|CV544806 | b_rapa | 428 | 57 | 82.42 | blastp |
| 151 | canola\|gb161\|CD830303 | canola | 429 | 57 | 82.65 | blastp |
| 152 | citrus\|gb166\|CK740093 | *citrus* | 430 | 57 | 83.98 | blastp |
| 153 | soybean\|gb168\|AW704756 | soybean | 431 | 57 | 80.78 | blastp |
| 154 | soybean\|gb168\|CB540306 | soybean | 432 | 57 | 81.69 | blastp |
| 155 | tomato\|gb164\|BG126144 | tomato | 433 | 57 | 81.01 | tblastn |
| 156 | b_rapa\|gb162\|CV432750 | b_rapa | 434 | 58 | 95.61 | blastp |
| 157 | b_rapa\|gb162\|ES933357 | b_rapa | 435 | 58 | 93.86 | blastp |
| 158 | canola\|gb161\|CN730767 | canola | 436 | 58 | 94.74 | blastp |
| 159 | canola\|gb161\|CX193104 | canola | 437 | 58 | 92.98 | blastp |
| 160 | canola\|gb161\|EE472289 | canola | 438 | 58 | 94.74 | blastp |
| 161 | canola\|gb161\|EV217368 | canola | 439 | 58 | 94.74 | blastp |
| 162 | cassava\|gb164\|DV446328 | cassava | 440 | 58 | 82.61 | blastp |
| 163 | citrus\|gb166\|CX667844 | *citrus* | 441 | 58 | 81.58 | blastp |
| 164 | papaya\|gb165\|EX265359 | *papaya* | 442 | 58 | 81.58 | blastp |
| 165 | radish\|gb164\|EW733783 | radish | 443 | 58 | 95.61 | blastp |
| 166 | radish\|gb164\|FD535333 | radish | 444 | 58 | 94.74 | blastp |
| 167 | canola\|gb161\|CD820476 | canola | 445 | 59 | 83.1 | blastp |
| 168 | arabidopsis\|gb165\|AT1G31258 | *arabidopsis* | 446 | 61 | 97.73 | blastp |
| 169 | arabidopsis\|gb165\|AT3G03240 | *arabidopsis* | 447 | 62 | 81.44 | blastp |
| 170 | canola\|gb161\|CD818131 | canola | 448 | 62 | 81.68 | blastp |
| 171 | radish\|gb164\|EX894603 | radish | 449 | 66 | 89.23 | blastp |
| 172 | canola\|gb161\|CD814119 | canola | 450 | 68 | 86.35 | blastp |
| 173 | canola\|gb161\|CD816209 | canola | 451 | 68 | 85.19 | blastp |
| 174 | b_rapa\|gb162\|ES934568 | b_rapa | 452 | 69 | 87.04 | tblastn |

TABLE 2-continued

Homologous polynucleotides and polypeptides

| Polynuc. SEQ ID NO: | Cluster name | Organism | Polypept. SEQ ID NO: | Homology to SEQ ID NO: | % identity | Algorithm |
|---|---|---|---|---|---|---|
| 175 | radish\|gb164\|EV538975 | radish | 453 | 69 | 84.39 | blastp |
| 176 | apple\|gb157.3\|AU223507 | apple | 454 | 71 | 81.18 | blastp |
| 177 | apple\|gb157.3\|CN579496 | apple | 455 | 71 | 82.35 | blastp |
| 178 | b_oleracea\|gb161\|AM385211 | b_oleracea | 456 | 71 | 97.2 | blastp |
| 179 | b_oleracea\|gb161\|AM386119 | b_oleracea | 457 | 71 | 83.6 | blastp |
| 180 | b_rapa\|gb162\|CX273145 | b_rapa | 458 | 71 | 95.6 | blastp |
| 181 | b_rapa\|gb162\|EX022604 | b_rapa | 459 | 71 | 96 | blastp |
| 182 | bean\|gb167\|FE686571 | bean | 460 | 71 | 80.31 | blastp |
| 183 | cacao\|gb167\|EH057755 | *cacao* | 461 | 71 | 83.07 | blastp |
| 184 | canola\|gb161\|CD834729 | canola | 462 | 71 | 95.6 | blastp |
| 185 | canola\|gb161\|CX192269 | canola | 463 | 71 | 97.2 | blastp |
| 186 | canola\|gb161\|H74607 | canola | 464 | 71 | 95.6 | blastp |
| 187 | cassava\|gb164\|DV443366 | cassava | 465 | 71 | 82.35 | blastp |
| 188 | citrus\|gb166\|BQ625207 | *citrus* | 466 | 71 | 81.57 | blastp |
| 189 | cotton\|gb164\|AI054775 | cotton | 467 | 71 | 82.75 | blastp |
| 190 | cowpea\|gb166\|FC457888 | cowpea | 468 | 71 | 80.71 | blastp |
| 191 | cynara\|gb167\|GE589236 | *cynara* | 469 | 71 | 80.4 | tblastn |
| 192 | dandelion\|gb161\|DY816357 | dandelion | 470 | 71 | 81.64 | blastp |
| 193 | grape\|gb160\|BM436371 | grape | 471 | 71 | 80.39 | blastp |
| 194 | lettuce\|gb157.2\|DW046017 | lettuce | 472 | 71 | 81.57 | blastp |
| 195 | lettuce\|gb157.2\|DW076019 | lettuce | 473 | 71 | 81.96 | blastp |
| 196 | lettuce\|gb157.2\|DW110290 | lettuce | 474 | 71 | 81.57 | blastp |
| 197 | lettuce\|gb157.2\|DW153964 | lettuce | 475 | 71 | 82.35 | blastp |
| 198 | lotus\|gb157.2\|CN825209 | *lotus* | 476 | 71 | 81.89 | blastp |
| 199 | melon\|gb165\|AM715906 | melon | 477 | 71 | 81.89 | blastp |
| 200 | papaya\|gb165\|EX227683 | *papaya* | 478 | 71 | 83.46 | blastp |
| 201 | peach\|gb157.2\|BU039450 | peach | 479 | 71 | 81.18 | blastp |
| 202 | peanut\|gb167\|CX127963 | peanut | 480 | 71 | 80.48 | tblastn |
| 203 | poplar\|gb157.2\|BI068247 | poplar | 481 | 71 | 80.78 | blastp |
| 204 | prunus\|gb167\|BU039450 | *prunus* | 482 | 71 | 81.18 | blastp |
| 205 | radish\|gb164\|EV567811 | radish | 483 | 71 | 92.8 | tblastn |
| 206 | radish\|gb164\|EV568452 | radish | 484 | 71 | 96.8 | blastp |
| 207 | radish\|gb164\|EV572670 | radish | 485 | 71 | 82.4 | blastp |
| 208 | safflower\|gb162\|EL387585 | safflower | 486 | 71 | 80.31 | blastp |
| 209 | soybean\|gb168\|AF272360 | soybean | 487 | 71 | 83.07 | blastp |
| 210 | soybean\|gb168\|AL370910 | soybean | 488 | 71 | 82.68 | blastp |
| 211 | soybean\|gb168\|BE661209 | soybean | 489 | 71 | 80 | tblastn |
| 212 | strawberry\|gb164\|CO817556 | strawberry | 490 | 71 | 81.18 | blastp |
| 213 | sunflower\|gb162\|DY915187 | sunflower | 491 | 71 | 82 | tblastn |
| 214 | sunflower\|gb162\|DY939330 | sunflower | 492 | 71 | 82 | tblastn |
| 215 | walnuts\|gb166\|CB303475 | walnuts | 493 | 71 | 82.28 | blastp |
| 216 | walnuts\|gb166\|CB303477 | walnuts | 494 | 71 | 80.8 | tblastn |
| 217 | b_rapa\|gb162\|EX017049 | b_rapa | 495 | 72 | 89.87 | blastp |
| 218 | canola\|gb161\|CD831601 | canola | 496 | 72 | 82.28 | tblastn |
| 219 | radish\|gb164\|EV547036 | radish | 497 | 72 | 89.87 | blastp |
| 220 | canola\|gb161\|CX189942 | canola | 498 | 76 | 89.59 | blastp |
| 221 | canola\|gb161\|H74865 | canola | 499 | 77 | 87.26 | blastp |
| 222 | castorbean\|gb160\|EG664225 | castorbean | 500 | 77 | 80.91 | tblastn |
| 223 | cotton\|gb164\|BG442642 | cotton | 501 | 77 | 81.82 | tblastn |
| 224 | grape\|gb160\|CB916567 | grape | 502 | 77 | 80.24 | blastp |
| 225 | poplar\|gb157.2\|BU816880 | poplar | 503 | 77 | 80.61 | tblastn |
| 226 | radish\|gb164\|EV537923 | radish | 504 | 77 | 86.61 | blastp |
| 227 | soybean\|gb168\|AW776674 | soybean | 505 | 77 | 80.29 | blastp |
| 228 | thellungiella\|gb167\|DN773780 | *thellungiella* | 506 | 77 | 94.26 | tblastn |
| 229 | b_juncea\|gb164\|EVGN00166916743135 | b_juncea | 507 | 79 | 88.75 | blastp |
| 230 | b_rapa\|gb162\|CX268133 | b_rapa | 508 | 79 | 90.95 | blastp |
| 231 | radish\|gb164\|EV573167 | radish | 509 | 79 | 89.73 | tblastn |
| 232 | radish\|gb164\|EW724071 | radish | 510 | 83 | 86.58 | blastp |
| 233 | b_rapa\|gb162\|EE517848 | b_rapa | 511 | 85 | 80.4 | blastp |
| 234 | canola\|gb161\|CD824985 | canola | 512 | 86 | 80.54 | blastp |
| 235 | b_oleracea\|gb161\|AM057266 | b_oleracea | 513 | 88 | 90.82 | blastp |
| 236 | b_rapa\|gb162\|BG543561 | b_rapa | 514 | 88 | 87.87 | blastp |
| 237 | canola\|gb161\|CD820232 | canola | 515 | 88 | 88.2 | blastp |
| 238 | canola\|gb161\|DW999252 | canola | 516 | 88 | 87.87 | blastp |
| 239 | potato\|gb157.2\|BG351102 | potato | 517 | 89 | 89.86 | blastp |
| 240 | potato\|gb157.2\|BI435634 | potato | 518 | 89 | 90.65 | blastp |
| 241 | radish\|gb164\|EY917873 | radish | 519 | 92 | 87.1 | blastp |
| 242 | antirrhinum\|gb166\|AJ797267 | *antirrhinum* | 520 | 93 | 80.08 | blastp |
| 243 | apple\|gb157.3\|CN489681 | apple | 521 | 93 | 88.28 | blastp |
| 244 | apricot\|gb157.2\|CV051536 | apricot | 522 | 93 | 88.33 | blastp |
| 245 | aquilegia\|gb157.3\|DT735665 | *aquilegia* | 523 | 93 | 82.85 | blastp |
| 246 | b_oleracea\|gb161\|ES939061 | b_oleracea | 524 | 93 | 82.85 | blastp |
| 247 | b_rapa\|gb162\|EX075010 | b_rapa | 525 | 93 | 92.08 | blastp |
| 248 | basilicum\|gb157.3\|DY334833 | *basilicum* | 526 | 93 | 86.67 | tblastn |

TABLE 2-continued

Homologous polynucleotides and polypeptides

| Polynuc. SEQ ID NO: | Cluster name | Organism | Polypept. SEQ ID NO: | Homology to SEQ ID NO: | % identity | Algorithm |
|---|---|---|---|---|---|---|
| 249 | bean|gb167|CV530444 | bean | 527 | 93 | 84.94 | blastp |
| 250 | cacao|gb167|CU490565 | *cacao* | 528 | 93 | 89.96 | blastp |
| 251 | canola|gb161|CD813794 | canola | 529 | 93 | 92.92 | blastp |
| 252 | canola|gb161|CD826913 | canola | 530 | 93 | 94.56 | blastp |
| 253 | canola|gb161|CN737313 | canola | 531 | 93 | 92.92 | blastp |
| 254 | cichorium|gb166|EH687081 | *cichorium* | 532 | 93 | 82.01 | tblastn |
| 255 | citrus|gb166|CF506133 | *citrus* | 533 | 93 | 89.54 | blastp |
| 256 | cotton|gb164|AI730510 | cotton | 534 | 93 | 85.77 | blastp |
| 257 | cotton|gb164|BF268340 | cotton | 535 | 93 | 82.57 | blastp |
| 258 | cowpea|gb166|FF384748 | cowpea | 536 | 93 | 85.77 | blastp |
| 259 | dandelion|gb161|DY819170 | dandelion | 537 | 93 | 81.17 | tblastn |
| 260 | eucalyptus|gb166|CT983920 | *eucalyptus* | 538 | 93 | 87.08 | blastp |
| 261 | grape|gb160|CD798978 | grape | 539 | 93 | 88.28 | blastp |
| 262 | lettuce|gb157.2|DW062039 | lettuce | 540 | 93 | 82.85 | blastp |
| 263 | melon|gb165|AM742165 | melon | 541 | 93 | 83.68 | blastp |
| 264 | poplar|gb157.2|CF234347 | poplar | 542 | 93 | 85.89 | blastp |
| 265 | poplar|gb157.2|CV241881 | poplar | 543 | 93 | 87.65 | blastp |
| 266 | potato|gb157.2|BG595485 | potato | 544 | 93 | 85.89 | blastp |
| 267 | prunus|gb167|AJ631796 | *prunus* | 545 | 93 | 88.33 | blastp |
| 268 | radish|gb164|EV567266 | radish | 546 | 93 | 92.92 | blastp |
| 269 | radish|gb164|EY912132 | radish | 547 | 93 | 92.08 | blastp |
| 270 | safflower|gb162|EL405854 | safflower | 548 | 93 | 82.01 | tblastn |
| 271 | soybean|gb168|BQ157726 | soybean | 549 | 93 | 87.45 | blastp |
| 272 | soybean|gb168|CD399194 | soybean | 550 | 93 | 86.72 | blastp |
| 273 | spurge|gb161|DV128393 | spurge | 551 | 93 | 88.7 | blastp |
| 274 | sunflower|gb162|DY918314 | sunflower | 552 | 93 | 80.83 | tblastn |
| 275 | thellungiella|gb167|BY820935 | *thellungiella* | 553 | 93 | 97.07 | tblastn |
| 276 | tobacco|gb162|EB445856 | tobacco | 554 | 93 | 84.71 | blastp |
| 277 | tomato|gb164|BG128536 | tomato | 555 | 93 | 86.31 | blastp |
| 278 | triphysaria|gb164|EY139231 | *triphysaria* | 556 | 93 | 83.4 | blastp |
| 279 | apple|gb157.3|CN489235 | apple | 557 | 94 | 83.95 | blastp |
| 280 | apple|gb157.3|CN490414 | apple | 558 | 94 | 83.78 | blastp |
| 281 | aquilegia|gb157.3|DR925212 | *aquilegia* | 559 | 94 | 83.64 | blastp |
| 282 | bean|gb167|CA905538 | bean | 560 | 94 | 83.06 | blastp |
| 283 | bean|gb167|CB542107 | bean | 561 | 94 | 83.27 | blastp |
| 284 | canola|gb161|CD816386 | canola | 562 | 94 | 87.18 | blastp |
| 285 | canola|gb161|CX187647 | canola | 563 | 94 | 89.98 | blastp |
| 286 | citrus|gb166|BE213456 | *citrus* | 564 | 94 | 83.44 | blastp |
| 287 | clover|gb162|BB936594 | clover | 565 | 94 | 81.48 | blastp |
| 288 | cotton|gb164|BG440364 | cotton | 566 | 94 | 80.82 | blastp |
| 289 | cowpea|gb166|FC460131 | cowpea | 567 | 94 | 83.12 | blastp |
| 290 | cowpea|gb166|FF541811 | cowpea | 568 | 94 | 83.74 | blastp |
| 291 | grape|gb160|BG273758 | grape | 569 | 94 | 80.29 | blastp |
| 292 | grape|gb160|BQ792941 | grape | 570 | 94 | 81.17 | blastp |
| 293 | lettuce|gb157.2|DW051431 | lettuce | 571 | 94 | 81.82 | blastp |
| 294 | lettuce|gb157.2|DW112484 | lettuce | 572 | 94 | 81.82 | blastp |
| 295 | medicago|gb157.2|AW688581 | *medicago* | 573 | 94 | 81.54 | tblastn |
| 296 | poplar|gb157.2|BI072710 | poplar | 574 | 94 | 82.51 | blastp |
| 297 | poplar|gb157.2|BU824581 | poplar | 575 | 94 | 82.79 | tblastn |
| 298 | potato|gb157.2|AW907286 | potato | 576 | 94 | 81.54 | tblastn |
| 299 | potato|gb157.2|BE921734 | potato | 577 | 94 | 82.3 | blastp |
| 300 | radish|gb164|EX747018 | radish | 578 | 94 | 80.88 | blastp |
| 301 | soybean|gb168|AL387670 | soybean | 579 | 94 | 82.4 | blastp |
| 302 | soybean|gb168|BG239139 | soybean | 580 | 94 | 82.3 | blastp |
| 303 | soybean|gb168|BG839432 | soybean | 581 | 94 | 83.37 | blastp |
| 304 | sunflower|gb162|CD847955 | sunflower | 582 | 94 | 82.1 | blastp |
| 305 | sunflower|gb162|CX944572 | sunflower | 583 | 94 | 81.57 | blastp |
| 306 | tobacco|gb162|GEXTOBTEFTUX1 | tobacco | 584 | 94 | 80.75 | blastp |
| 307 | tomato|gb164|BG124614 | tomato | 585 | 94 | 80.53 | blastp |
| 308 | tomato|gb164|BG125985 | tomato | 586 | 94 | 81.99 | blastp |
| 309 | canola|gb161|CD827895 | canola | 587 | 95 | 92.49 | blastp |
| 310 | canola|gb161|CX188753 | canola | 588 | 95 | 92.69 | blastp |
| 311 | b_rapa|gb162|L35822 | b_rapa | 589 | 96 | 88.19 | blastp |
| 312 | canola|gb161|CD813792 | canola | 590 | 96 | 88.93 | blastp |
| 313 | radish|gb164|EV526073 | radish | 591 | 96 | 88.19 | blastp |
| 314 | radish|gb164|EW729491 | radish | 592 | 96 | 88.19 | blastp |
| 315 | arabidopsis|gb165|AT2G36830 | *arabidopsis* | 593 | 97 | 85.38 | blastp |
| 316 | b_juncea|gb164|EVGN00082509070705 | b_juncea | 594 | 97 | 90.51 | blastp |
| 317 | b_juncea|gb164|EVGN00089315240635 | b_juncea | 595 | 97 | 92.09 | blastp |
| 318 | b_juncea|gb164|EVGN00116217230337 | b_juncea | 596 | 97 | 90.51 | blastp |
| 319 | b_juncea|gb164|EVGN00256308610946 | b_juncea | 597 | 97 | 92.09 | tblastn |
| 320 | b_juncea|gb164|EVGN00465908341698 | b_juncea | 598 | 97 | 84.58 | blastp |
| 321 | b_juncea|gb164|EVGN01252008670772 | b_juncea | 599 | 97 | 83.79 | blastp |
| 322 | b_oleracea|gb161|AM385528 | b_oleracea | 600 | 97 | 91.3 | blastp |

TABLE 2-continued

Homologous polynucleotides and polypeptides

| Polynuc. SEQ ID NO: | Cluster name | Organism | Polypept. SEQ ID NO: | Homology to SEQ ID NO: | % identity | Algorithm |
|---|---|---|---|---|---|---|
| 323 | b_oleracea\|gb161\|BOU92651 | b_oleracea | 601 | 97 | 84.19 | blastp |
| 324 | b_rapa\|gb162\|BG545002 | b_rapa | 602 | 97 | 84.58 | blastp |
| 325 | b_rapa\|gb162\|BQ791222 | b_rapa | 603 | 97 | 86.17 | blastp |
| 326 | b_rapa\|gb162\|L37468 | b_rapa | 604 | 97 | 91.3 | blastp |
| 327 | canola\|gb161\|AF118381 | canola | 605 | 97 | 84.19 | blastp |
| 328 | canola\|gb161\|CD815565 | canola | 606 | 97 | 91.3 | blastp |
| 329 | canola\|gb161\|CD824493 | canola | 607 | 97 | 84.58 | blastp |
| 330 | canola\|gb161\|CD841035 | canola | 608 | 97 | 91.3 | blastp |
| 331 | canola\|gb161\|CN729037 | canola | 609 | 97 | 84.58 | blastp |
| 332 | canola\|gb161\|CX187880 | canola | 610 | 97 | 90.91 | blastp |
| 333 | radish\|gb164\|D84669 | radish | 611 | 97 | 90.91 | blastp |
| 334 | radish\|gb164\|EV549107 | radish | 612 | 97 | 91.3 | blastp |
| 335 | radish\|gb164\|EV569856 | radish | 613 | 97 | 84.58 | blastp |
| 336 | radish\|gb164\|EX748154 | radish | 614 | 97 | 83.79 | blastp |
| 337 | thellungiella\|gb167\|EE683447 | *thellungiella* | 615 | 97 | 91.7 | blastp |
| 338 | canola\|gb161\|H74506 | canola | 616 | 98 | 88.54 | blastp |
| 339 | radish\|gb164\|EW716884 | radish | 617 | 98 | 88.19 | blastp |
| 340 | barley\|gb157.3\|AL450752 | barley | 618 | 99 | 82.46 | blastp |
| 341 | brachypodium\|gb169\|BE399053 | *brachypodium* | 619 | 99 | 85.96 | blastp |
| 342 | cenchrus\|gb166\|EB653861 | *cenchrus* | 620 | 99 | 86.84 | blastp |
| 343 | fescue\|gb161\|DT683655 | fescue | 621 | 99 | 80.7 | blastp |
| 344 | leymus\|gb166\|CD809085 | *leymus* | 622 | 99 | 84.21 | blastp |
| 345 | lovegrass\|gb167\|DN480336 | lovegrass | 623 | 99 | 86.84 | blastp |
| 346 | lovegrass\|gb167\|DN480721 | lovegrass | 624 | 99 | 83.33 | tblastn |
| 347 | lovegrass\|gb167\|EH184046 | lovegrass | 625 | 99 | 85.96 | blastp |
| 348 | maize\|gb169.2\|AI586696 | maize | 626 | 99 | 84.21 | blastp |
| 349 | maize\|gb169.2\|AI619158 | maize | 627 | 99 | 85.22 | blastp |
| 350 | maize\|gb169.2\|AI619355 | maize | 628 | 99 | 84.21 | blastp |
| 351 | maize\|gb169.2\|AI783324 | maize | 629 | 99 | 85.96 | blastp |
| 352 | maize\|gb169.2\|DQ244850 | maize | 630 | 99 | 84.21 | blastp |
| 353 | maize\|gb169.2\|FK957562 | maize | 631 | 99 | 83.33 | tblastn |
| 354 | maize\|gb169.2\|X86553 | maize | 632 | 99 | 85.96 | blastp |
| 355 | millet\|gb161\|CD725537 | millet | 633 | 99 | 85.96 | blastp |
| 356 | pseudoroegneria\|gb167\|FF359011 | *pseudoroegneria* | 634 | 99 | 84.21 | blastp |
| 357 | rice\|gb157.3\|C26798 | rice | 635 | 99 | 83.33 | blastp |
| 358 | sorghum\|gb161.crp\|AI621929 | *sorghum* | 636 | 99 | 87.72 | blastp |
| 359 | sorghum\|gb161.crp\|AI666179 | *sorghum* | 637 | 99 | 85.96 | blastp |
| 360 | sorghum\|gb161.crp\|CD222293 | *sorghum* | 638 | 99 | 81.58 | blastp |
| 361 | sugarcane\|gb157.3\|BQ478960 | sugarcane | 639 | 99 | 86.84 | blastp |
| 362 | sugarcane\|gb157.3\|BQ537227 | sugarcane | 640 | 99 | 85.96 | blastp |
| 363 | sugarcane\|gb157.3\|CA074008 | sugarcane | 641 | 99 | 85.96 | blastp |
| 364 | sugarcane\|gb157.3\|CA112912 | sugarcane | 642 | 99 | 81.74 | blastp |
| 365 | switchgrass\|gb167\|DN150202 | switchgrass | 643 | 99 | 86.84 | blastp |
| 366 | switchgrass\|gb167\|FE615220 | switchgrass | 644 | 99 | 86.84 | blastp |
| 367 | switchgrass\|gb167\|FL725679 | switchgrass | 645 | 99 | 85.96 | blastp |
| 368 | switchgrass\|gb167\|FL732781 | switchgrass | 646 | 99 | 86.84 | blastp |
| 369 | switchgrass\|gb167\|FL846775 | switchgrass | 647 | 99 | 85.34 | blastp |
| 370 | switchgrass\|gb167\|FL899116 | switchgrass | 648 | 99 | 85.96 | blastp |
| 371 | switchgrass\|gb167\|FL979422 | switchgrass | 649 | 99 | 85.96 | blastp |
| 372 | wheat\|gb164\|BE398366 | wheat | 650 | 99 | 84.21 | blastp |
| 373 | wheat\|gb164\|BE399053 | wheat | 651 | 99 | 84.21 | blastp |
| 374 | barley\|gb157.3\|BF623452 | barley | 652 | 100 | 85.25 | tblastn |
| 375 | maize\|gb169.2\|AW267619 | maize | 653 | 100 | 80.58 | tblastn |
| 376 | pseudoroegneria\|gb167\|FF352828 | *pseudoroegneria* | 654 | 100 | 84.89 | blastp |
| 377 | sorghum\|gb161.crp\|AW438249 | *sorghum* | 655 | 100 | 86.43 | blastp |
| 378 | wheat\|gb164\|BQ905354 | wheat | 656 | 100 | 85.97 | tblastn |
| 755 | amborella\|gb166\|CD482678 | amborella | 764 | 97 | 81.03 | blastp |
| 756 | castorbean\|gb160\|AJ605571 | castorbean | 765 | 97 | 80.24 | blastp |
| 757 | cotton\|gb164\|AI055329 | cotton | 766 | 97 | 83.79 | blastp |
| 758 | cotton\|gb164\|AI731742 | cotton | 767 | 97 | 83.79 | blastp |
| 759 | liriodendron\|gb166\|CK744430 | *liriodendron* | 768 | 97 | 81.42 | blastp |
| 760 | papaya\|gb165\|EX246150 | *papaya* | 769 | 97 | 81.82 | blastp |
| 761 | periwinkle\|gb164\|EG554262 | periwinkle | 770 | 97 | 80.24 | blastp |
| 762 | spurge\|gb161\|AW990927 | spurge | 771 | 97 | 80.63 | blastp |
| 763 | tobacco\|gb162\|CV018899 | tobacco | 772 | 97 | 80.24 | blastp |
| 773 | canola\|gb161\|DW999739 | canola | 774 | 747 | 82.78 | blastp |

Table 2: Provided are polynucleotides and polypeptides which are homologous to the identified polynucleotides or polypeptides of Table 1.

Note that the following polypeptide sequences are 100% identical: SEQ ID NO: 201 is identical to SEQ ID NO: 204; SEQ ID NO: 409 is identical to SEQ ID NO: 410; SEQ ID NO: 411 is identical to SEQ ID NO: 412; SEQ ID NO: 456 is identical to SEQ ID NO: 463; SEQ ID NO: 458 is identical to SEQ ID NO: 462; SEQ ID NO: 472 is identical to SEQ ID NO: 474; SEQ ID NO: 479 is identical to SEQ ID NO: 482; SEQ ID NO: 514 is identical to SEQ ID NO: 516; SEQ ID NO: 522 is identical to SEQ ID NO: 545; SEQ ID NO: 600 is identical to SEQ ID NO: 604, 606 and 608; SEQ ID NO: 602 is identical to SEQ ID NO: 607 and 609; SEQ ID NO: 610 is identical to SEQ ID NO: 611; SEQ ID NO: 620 is identical to SEQ ID NO: 643; SEQ ID NO: 622 is identical to SEQ ID NO: 630, 634, 650 and 65; SEQ ID NO: 629 is identical to SEQ ID NO: 632; SEQ ID NO: 637 is identical # to SEQ ID NO: 640 and 641; SEQ ID NO: 644 is identical to SEQ ID NO: 646; SEQ ID NO: 648 is identical to SEQ ID NO: 649; SEQ ID NO: 650 is identical to SEQ ID NO: 651; SEQ ID NO: 624 is identical to SEQ ID NO: 625.

Example 3

Production of Arabidopsis Transcription and High Throughput Correlation Analysis Using 44K Arabidopsis Full Genome Oligonucleotide Micro-Array To produce a high throughput correlation analysis, the present inventors utilized an *Arabidopsis thaliana* oligonucleotide micro-array, produced by Agilent Technologies [chem. (dot) agilent (dot) com/Scripts/PDS (dot) asp?1Page=50879]. The array oligonucleotide represents about 40,000 *A. thaliana* genes and transcripts designed based on data from the TIGR ATH1 v.5 database and Arabidopsis MPSS (University of Delaware) databases. To define correlations between the levels of RNA expression and yield components or vigor related parameters, various plant characteristics of 15 different Arabidopsis ecotypes were analyzed. Among them, nine ecotypes encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

RNA extraction—Five tissues at different developmental stages including root, leaf, flower at anthesis, seed at 5 days after flowering (DAF) and seed at 12 DAF, representing different plant characteristics, were sampled and RNA was extracted using TRIZOL® Reagent (Life Technologies) from Invitrogen [invitrogen (dot) com/content (dot) cfm?pageid=469]. For convenience, each micro-array expression information tissue type has received a Set ID as summarized in Table 3 below.

TABLE 3

*Arabidopsis* transcriptom experimental sets

| Expression Set | Set ID |
|---|---|
| Root | A |
| Leaf | B |
| Flower | C |
| Seed 5 DAF | D |
| Seed 12 DAF | E |

Table 3. Provided are the *Arabidopsis* transcriptom experimental sets (A-E).
DAF = days after flowering.

Approximately 30-50 mg of tissue was taken from samples. The weighed tissues were ground using pestle and mortar in liquid nitrogen and resuspended in 500 ill of TRIzol Reagent. To the homogenized lysate, 100 μl of chloroform was added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol.

Yield component and vigor related parameters assessment—eight out of the nine Arabidopsis ecotypes were used in each of 5 repetitive blocks (named A, B, C, D and E), each containing 20 plants per plot were grown at control conditions greenhouse 22° C., 20:20:20 (weight ratios) N:P:K [nitrogen (N), phosphorus (P) and potassium (K)] fertilizer was added. During this time data was collected documented and analyzed. Additional data was collected through the seedling stage of plants grown at tissue culture in vertical grown transparent agar plates. Most of chosen parameters were analyzed by digital imaging.

Digital imaging in Tissue culture—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) and located in a darkroom, was used for capturing images of plantlets sawn in square agar plates.

Digital imaging in Greenhouse—The image capturing process was repeated every 3-4 days starting at day 7 till day 30. The same camera attached with a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37, Java based image processing program, which was developed at the U.S National Institutes of Health and is freely available on the internet at rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images (FIGS. 1*a-d*). The blade circularity was calculated as laminar width divided by laminar length.

Root analysis—During 17 days, the different ecotypes were grown in transparent agar plates. The plates were photographed every 2 days starting at day 7 in the photography room and the roots development was documented (FIGS. 2*a-b*). The growth rate was calculated according to the formula I as described above [Relative growth area rate=(ΔArea/Δt)*(1/Area t0)].

Vegetative growth rate analysis—The growth rate was calculated by dividing the area added (Δ Area) by the number of days for each interval (Δt). The analysis was ended with the appearance of overlapping plants. The growth rate was calculated according to Formula IV.

$$\text{Growth rate} = \Delta\text{Area}/\Delta t. \qquad \text{Formula IV:}$$

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra—Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil yield—The oil yield was calculated using Formula V.

Seed Oil yield=Seed yield per plant (*gr*)*Oil % in seed     Formula V

Harvest Index—The harvest index was calculated using Formula III as described above [Harvest Index=Average seed yield per plant/Average dry weight].

Experimental Results

Nine different Arabidopsis ecotypes were grown and characterized for 18 parameters (named as vectors). Data parameters are summarized in Table 4, below.

TABLE 4

*Arabidopsis* correlated parameters (vectors)

| Correlated parameter with | Correlation ID |
|---|---|
| Root length day 13 (cm) | 1 |
| Root length day 7 (cm) | 2 |
| Relative root growth (cm/day) day 13 | 3 |
| Fresh weight per plant (gr) at bolting stage | 4 |
| Dry matter per plant (gr) | 5 |
| Vegetative growth rate ($cm^2$/day) till 8 true leaves | 6 |
| Blade circularity | 7 |
| Lamina width (cm) | 8 |
| Lamina length (cm) | 9 |
| Total leaf area per plant (cm) | 10 |
| 1000 Seed weight (gr) | 11 |
| Oil % per seed | 12 |
| Seeds per silique | 13 |
| Silique length (cm) | 14 |
| Seed yield per plant (gr) | 15 |
| Oil yield per plant (mg) | 16 |
| Harvest Index | 17 |
| Leaf width/length | 18 |

Table 4. Provided are the *Arabidopsis* correlated parameters (correlation ID Nos. 1-18).

The characterized values are summarized in Tables 5 and 6 below.

TABLE 5

*Arabidopsis* ecotypes measured parameters

| Ecotype | Seed yield per plant (gr) | Oil yield per plant (mg) | Oil % per seed | 1000 Seed weight (gr) | Dry matter per plant (gr) | Harvest Index | Total leaf area per plant (cm) | Seeds per silique | Silique length (cm) |
|---|---|---|---|---|---|---|---|---|---|
| An-1 | 0.34 | 118.63 | 34.42 | 0.0203 | 0.64 | 0.53 | 46.86 | 45.44 | 1.06 |
| Col-0 | 0.44 | 138.73 | 31.19 | 0.0230 | 1.27 | 0.35 | 109.89 | 53.47 | 1.26 |
| Ct-1 | 0.59 | 224.06 | 38.05 | 0.0252 | 1.05 | 0.56 | 58.36 | 58.47 | 1.31 |
| Cvi (N8580) | 0.42 | 116.26 | 27.76 | 0.0344 | 1.28 | 0.33 | 56.80 | 35.27 | 1.47 |
| Gr-6 | 0.61 | 218.27 | 35.49 | 0.0202 | 1.69 | 0.37 | 114.66 | 48.56 | 1.24 |
| Kondara | 0.43 | 142.11 | 32.91 | 0.0263 | 1.34 | 0.32 | 110.82 | 37.00 | 1.09 |
| Ler-1 | 0.36 | 114.15 | 31.56 | 0.0205 | 0.81 | 0.45 | 88.49 | 39.38 | 1.18 |
| Mt-0 | 0.62 | 190.06 | 30.79 | 0.0226 | 1.21 | 0.51 | 121.79 | 40.53 | 1.18 |
| Shakdara | 0.55 | 187.62 | 34.02 | 0.0235 | 1.35 | 0.41 | 93.04 | 25.53 | 1.00 |

Table 5. Provided are the parameters measured in *Arabidopsis* ecotypes: Seed yield per plant (cm); oil yield per plant (mg); oil % per seed; 1000 seed weight (gr); dry matter per plant (gr); harvest index; Total leaf area per plant (cm); seeds per silique; Silique length (cm).

TABLE 6

| *Arabidopsis* ecotypes, additional measured parameters | | | | | | | | | |
|---|---|---|---|---|---|---|---|---|---|
| Ecotype | Veg. GR | Relat. root growth | Root length day 7 | Root length day 13 | Fresh weight per plant | Lam. Leng. | Lam. width | Leaf width/ length | Blade circularity |
| An-1 | 0.313 | 0.631 | 0.937 | 4.419 | 1.510 | 2.767 | 1.385 | 0.353 | 0.509 |
| Col-0 | 0.378 | 0.664 | 1.759 | 8.530 | 3.607 | 3.544 | 1.697 | 0.288 | 0.481 |
| Ct-1 | 0.484 | 1.176 | 0.701 | 5.621 | 1.935 | 3.274 | 1.460 | 0.316 | 0.450 |
| Cvi (N8580) | 0.474 | 1.089 | 0.728 | 4.834 | 2.082 | 3.785 | 1.374 | 0.258 | 0.370 |
| Gr-6 | 0.425 | 0.907 | 0.991 | 5.957 | 3.556 | 3.690 | 1.828 | 0.356 | 0.501 |
| Kondara | 0.645 | 0.774 | 1.163 | 6.372 | 4.338 | 4.597 | 1.650 | 0.273 | 0.376 |
| Ler-1 | 0.430 | 0.606 | 1.284 | 5.649 | 3.467 | 3.877 | 1.510 | 0.305 | 0.394 |
| Mt-0 | 0.384 | 0.701 | 1.414 | 7.060 | 3.479 | 3.717 | 1.817 | 0.335 | 0.491 |
| Shakdara | 0.471 | 0.782 | 1.251 | 7.041 | 3.710 | 4.149 | 1.668 | 0.307 | 0.409 |

Table 6. Provided are the parameters measured in *Arabidopsis* ecotypes:
Veg. GR = vegetative growth rate ($cm^2$/day) until 8 true leaves;
Relat. Root growth = relative root growth (cm/day); Root length day 7 (cm); Root length day 13 (cm); fresh weight per plant (gr) at bolting stage;
Lam. Leng. = Lamima length (cm);
Lam. Width = Lamina width (cm); Leaf width/length; Blade circularity.

Tables 7-9, below, provide the selected genes, the characterized parameters (which are used as x axis for correlation) and the correlated tissue transcription along with the correlation value (R, calculated using Pearson correlation).

TABLE 7

| *Arabidopsis* selected genes and their correlation with yield (seed yield, oil yield, oil content), biomass, growth rate and/or vigor components among different transcriptom sets | | | | | | | | | | | | | | |
|---|---|---|---|---|---|---|---|---|---|---|---|---|---|---|
| Gene Name | Cluster Name | Exp. Set | Corr. Vec. | R | Exp. Set | Corr. Vec. | R | Exp. Set | Corr. Vec. | R | Exp. Set | Corr. Vec. | R |
| BDL112 | AT3G23510 | B | 7 | 0.84 | D | 17 | 0.90 | D | 8 | −0.88 | D | 10 | −0.94 |
| BDL113 | AT2G45310 | B | 8 | 0.85 | D | 13 | 0.91 | D | 14 | 0.91 | B | 10 | 0.83 |
| BDL114 | AT5G27820 | B | 16 | 0.92 | D | 6 | 0.88 | B | 15 | 0.94 | | | |
| BDL115 | AT4G11090 | C | 8 | 0.85 | A | 8 | 0.81 | C | 10 | 0.90 | B | 10 | 0.92 |
| BDL116 | AT4G24175 | B | 16 | 0.92 | B | 15 | 0.91 | | | | | | |
| BDL119 | AT3G47965 | D | 16 | 0.93 | D | 15 | 0.93 | | | | | | |
| BDL120 | AT3G03230 | D | 16 | 0.95 | D | 3 | 0.89 | D | 15 | 0.96 | | | |
| BDL122 | AT3G49000 | D | 17 | 0.96 | D | 8 | −0.92 | D | 10 | −0.96 | E | 6 | 0.83 |
| BDL123 | AT2G21860 | A | 16 | 0.82 | D | 13 | 0.92 | D | 14 | 0.94 | A | 15 | 0.86 |
| BDL124 | AT5G51590 | D | 12 | 0.93 | C | 16 | 0.93 | A | 1 | −0.85 | D | 2 | −0.91 |
| BDL125 | AT3G16180 | D | 16 | −0.91 | D | 15 | −0.93 | | | | | | |
| BDL128 | AT1G60770 | D | 5 | −0.86 | D | 17 | 0.82 | D | 8 | −0.91 | E | 14 | 0.88 |
| BDL130 | AT3G03870 | C | 9 | −0.82 | D | 13 | 0.85 | D | 14 | 0.94 | C | 6 | −0.85 |
| BDL131 | AT4G27450 | A | 1 | 0.92 | A | 2 | 0.91 | | | | | | |
| BDL132 | AT4G23730 | D | 13 | 0.90 | C | 14 | 0.94 | D | 14 | 0.91 | C | 3 | 0.81 |
| BDL133 | AT3G06150 | D | 13 | 0.86 | C | 14 | 0.90 | D | 14 | 0.92 | | | |
| BDL134 | AT3G28420 | D | 13 | 0.92 | D | 14 | 0.91 | E | 3 | 0.81 | E | 11 | 0.80 |
| BDL135 | AT3G18600 | D | 12 | 0.96 | D | 16 | 0.87 | D | 3 | 0.93 | D | 2 | −0.81 |
| BDL136 | AT3G22990 | D | 12 | 0.90 | C | 16 | 0.83 | D | 16 | 0.81 | D | 3 | 0.89 |
| BDL137 | AT5G14530 | B | 12 | 0.83 | D | 12 | 0.83 | B | 16 | 0.83 | D | 16 | 0.81 |
| BDL139 | AT1G29800 | C | 13 | 0.87 | B | 13 | 0.85 | | | | | | |
| BDL141 | AT1G29980 | D | 18 | 0.90 | C | 16 | 0.81 | B | 16 | 0.81 | A | 3 | 0.83 |
| BDL142 | AT2G39110 | C | 16 | 0.82 | D | 16 | 0.83 | B | 3 | 0.86 | D | 3 | 0.90 |
| BDL143 | AT1G62810 | A | 13 | 0.94 | D | 13 | 0.82 | | | | | | |
| BDL144 | AT3G14890 | C | 16 | 0.81 | | | | | | | | | |
| BDL145 | AT1G24470 | C | 13 | 0.89 | B | 13 | 0.82 | D | 14 | 0.80 | | | |
| BDL146 | AT3G09310 | C | 14 | 0.85 | C | 3 | 0.81 | B | 3 | 0.92 | A | 3 | 0.91 |
| BDL148 | AT4G35785 | D | 17 | 0.91 | D | 10 | −0.93 | D | 4 | −0.89 | B | 3 | 0.82 |
| BDL42 | AT5G13170 | B | 11 | 0.88 | | | | | | | | | |
| BDL51 | AT5G64260 | E | 9 | −0.81 | A | 8 | −0.82 | D | 13 | −0.83 | B | 14 | 0.82 |
| BDL54 | AT2G41090 | A | 6 | 0.82 | B | 3 | −0.86 | | | | | | |
| BDL60 | AT2G45200 | C | 7 | −0.88 | | | | | | | | | |
| BDL65 | AT4G20360 | B | 7 | −0.81 | B | 18 | −0.88 | B | 12 | −0.82 | D | 11 | 0.89 |
| BDL78 | AT3G26520 | D | 13 | 0.84 | | | | | | | | | |
| BDL149 | AT5G15750 | B | 14 | 0.83 | | | | | | | | | |
| BDL149 | AT5G15750 | A | 14 | 0.95 | B | 3 | 0.89 | | | | | | |

Table 7. Provided are *Arabidopsis* selected genes and their correlation with yield (seed yield, oil yield, oil content), biomass, growth rate and/or vigor components among different transcriptom sets.
Corr. Vec. = correlation vector;
Exp. Set = experimental set.

TABLE 8

*Arabidopsis* selected genes and their correlation with yield (seed yield, oil yield, oil content), biomass, growth rate and/or vigor components among different transcriptom sets

| Gene Name | Cluster Name | Exp. Set | Corr. Vec. | R | Exp. Set | Corr. Vec. | R | Exp. Set | Corr. Vec. | R | Exp. Set | Corr. Vec. | R |
|---|---|---|---|---|---|---|---|---|---|---|---|---|---|
| BDL112 | AT3G23510 | D | 4 | −0.84 | | | | | | | | | |
| BDL113 | AT2G45310 | | | | | | | | | | | | |
| BDL114 | AT5G27820 | | | | | | | | | | | | |
| BDL115 | AT4G11090 | A | 10 | 0.82 | D | 10 | 0.80 | C | 4 | 0.93 | B | 4 | 0.96 |
| BDL116 | AT4G24175 | | | | | | | | | | | | |
| BDL119 | AT3G47965 | | | | | | | | | | | | |
| BDL120 | AT3G03230 | | | | | | | | | | | | |
| BDL122 | AT3G49000 | D | 4 | −0.84 | A | 11 | 0.88 | | | | | | |
| BDL123 | AT2G21860 | | | | | | | | | | | | |
| BDL124 | AT5G51590 | C | 15 | 0.91 | | | | | | | | | |
| BDL125 | AT3G16180 | | | | | | | | | | | | |
| BDL128 | AT1G60770 | D | 10 | −0.84 | A | 1 | −0.94 | D | 1 | −0.86 | A | 2 | −0.83 |
| BDL130 | AT3G03870 | | | | | | | | | | | | |
| BDL131 | AT4G27450 | | | | | | | | | | | | |
| BDL132 | AT4G23730 | | | | | | | | | | | | |
| BDL133 | AT3G06150 | | | | | | | | | | | | |
| BDL134 | AT3G28420 | | | | | | | | | | | | |
| BDL135 | AT3G18600 | | | | | | | | | | | | |
| BDL136 | AT3G22990 | | | | | | | | | | | | |
| BDL137 | AT5G14530 | C | 3 | 0.89 | D | 3 | 0.89 | | | | | | |
| BDL139 | AT1G29800 | | | | | | | | | | | | |
| BDL141 | AT1G29980 | C | 15 | 0.84 | B | 15 | 0.85 | | | | | | |
| BDL142 | AT2G39110 | | | | | | | | | | | | |
| BDL143 | AT1G62810 | | | | | | | | | | | | |
| BDL144 | AT3G14890 | | | | | | | | | | | | |
| BDL145 | AT1G24470 | | | | | | | | | | | | |
| BDL146 | AT3G09310 | A | 2 | −0.81 | C | 11 | 0.83 | D | 11 | 0.81 | | | |
| BDL148 | AT4G35785 | E | 1 | 0.88 | | | | | | | | | |
| BDL42 | AT5G13170 | | | | | | | | | | | | |
| BDL51 | AT5G64260 | D | 14 | −0.88 | E | 6 | −0.82 | B | 11 | 0.87 | | | |
| BDL54 | AT2G41090 | | | | | | | | | | | | |
| BDL60 | AT2G45200 | | | | | | | | | | | | |
| BDL65 | AT4G20360 | | | | | | | | | | | | |
| BDL78 | AT3G26520 | | | | | | | | | | | | |
| BDL149 | AT5G15750 | | | | | | | | | | | | |
| BDL149 | AT5G15750 | D | 4 | −0.84 | | | | | | | | | |

Table 8. Provided are *Arabidopsis* selected genes and their correlation with yield (seed yield, oil yield, oil content), biomass, growth rate and/or vigor components among different transcriptom sets.
Corr. Vec. = correlation vector;
Exp. Set = experimental set.

TABLE 9

*Arabidopsis* selected genes and their correlation with yield (seed yield, oil yield, oil content), biomass, growth rate and/or vigor components among different transcriptom sets

| Gene Name | Cluster Name | Exp. Set | Corr. Vec. | R |
|---|---|---|---|---|
| BDL112 | AT3G23510 | | | |
| BDL113 | AT2G45310 | | | |
| BDL114 | AT5G27820 | | | |
| BDL115 | AT4G11090 | A | 4 | 0.86 |
| BDL116 | AT4G24175 | | | |
| BDL119 | AT3G47965 | | | |
| BDL120 | AT3G03230 | | | |
| BDL122 | AT3G49000 | | | |
| BDL123 | AT2G21860 | | | |
| BDL124 | AT5G51590 | | | |
| BDL125 | AT3G16180 | | | |
| BDL128 | AT1G60770 | | | |
| BDL130 | AT3G03870 | | | |
| BDL131 | AT4G27450 | | | |
| BDL132 | AT4G23730 | | | |
| BDL133 | AT3G06150 | | | |
| BDL134 | AT3G28420 | | | |
| BDL135 | AT3G18600 | | | |
| BDL136 | AT3G22990 | | | |
| BDL137 | AT5G14530 | | | |
| BDL139 | AT1G29800 | | | |
| BDL141 | AT1G29980 | | | |
| BDL142 | AT2G39110 | | | |
| BDL143 | AT1G62810 | | | |
| BDL144 | AT3G14890 | | | |
| BDL145 | AT1G24470 | | | |
| BDL146 | AT3G09310 | | | |
| BDL148 | AT4G35785 | | | |
| BDL42 | AT5G13170 | | | |
| BDL51 | AT5G64260 | | | |
| BDL54 | AT2G41090 | | | |
| BDL60 | AT2G45200 | | | |
| BDL65 | AT4G20360 | | | |
| BDL78 | AT3G26520 | | | |
| BDL149 | AT5G15750 | | | |
| BDL149 | AT5G15750 | | | |

Table 9. Provided are *Arabidopsis* selected genes and their correlation with yield (seed yield, oil yield, oil content), biomass, growth rate and/or vigor components among different transcriptom sets.
Corr. Vec. = correlation vector;
Exp. Set = experimental set.

Tables 10 and 11, below, provide data about the homologous of selected genes, the characterized parameters (which are used as x axis for correlation) and the correlated tissue transcription along with the correlation value (R, calculated using Pearson correlation).

TABLE 10

Homologous of *Arabidopsis* selected genes and their correlation with yield (seed yield, oil yield, oil content), biomass, growth rate and/or vigor components among different transcriptom sets

| Gene Name | Cluster Name | Exp. Set | Corr. Vec. | R | Exp. Set | Corr. Vec. | R | Exp. Set | Corr. Vec. | R | Exp. Set | Corr. Vec. | R |
|---|---|---|---|---|---|---|---|---|---|---|---|---|---|
| BDL110_H0 | AT1G21760 | D | 17 | 0.97 | D | 8 | −0.81 | B | 16 | 0.82 | D | 10 | −0.91 |
| BDL113_H0 | AT1G02000 | B | 13 | −0.81 | | | | | | | | | |
| BDL113_H1 | AT2G45315 | E | 1 | 0.92 | | | | | | | | | |
| BDL113_H2 | AT4G00110 | B | 18 | −0.84 | E | 14 | 0.87 | E | 11 | 0.87 | | | |
| BDL120_H0 | AT3G03240 | D | 16 | 0.89 | C | 4 | −0.84 | D | 15 | 0.88 | | | |
| BDL78_H0 | AT2G36830 | B | 12 | −0.92 | C | 2 | −0.87 | | | | | | |

Table 10. Provided are homologous of *Arabidopsis* selected genes and their correlation with yield (seed yield, oil yield, oil content), biomass, growth rate and/or vigor components among different transcriptom sets.

Corr. Vec. = correlation vector;

Exp. Set = experimental set.

TABLE 11

Homologous of *Arabidopsis* selected genes and their correlation with yield (seed yield, oil yield, oil content), biomass, growth rate and/or vigor components among different transcriptom sets

| Gene Name | Cluster Name | Exp. Set | Corr. Vec. | R | Exp. Set | Corr. Vec. | R | Exp. Set | Corr. Vec. | R | Exp. Set | Corr. Vec. | R |
|---|---|---|---|---|---|---|---|---|---|---|---|---|---|
| BDL110_H0 | AT1G21760 | D | 4 | −0.85 | B | 3 | 0.81 | A | 3 | 0.92 | B | 15 | 0.87 |
| BDL113_H0 | AT1G02000 | | | | | | | | | | | | |
| BDL113_H1 | AT2G45315 | | | | | | | | | | | | |
| BDL113_H2 | AT4G00110 | | | | | | | | | | | | |
| BDL120_H0 | AT3G03240 | | | | | | | | | | | | |
| BDL78_H0 | AT2G36830 | | | | | | | | | | | | |

Table 11. Provided are homologous of *Arabidopsis* selected genes and their correlation with yield (seed yield, oil yield, oil content), biomass, growth rate and/or vigor components among different transcriptom sets.

Corr. Vec. = correlation vector;

Exp. Set = experimental set.

Example 4

Gene Cloning and Generation of Binary Vectors for Plant Expression

To validate their role in improving oil content, plant yield, seed yield, biomass, growth rate, ABST, NUE and/or vigor, selected genes were over-expressed in plants, as follows.

Cloning Strategy

Genes listed in Example 1 hereinabove were cloned into binary vectors for the generation of transgenic plants. For cloning, the full-length open reading frame (ORF) was first identified. In case of ORF-EST clusters and in some cases already published mRNA sequences were analyzed to identify the entire open reading frame by comparing the results of several translation algorithms to known proteins from other plant species. To clone the full-length cDNAs, reverse transcription (RT) followed by polymerase chain reaction (PCR; RT-PCR) was performed on total RNA extracted from leaves, flowers, siliques or other plant tissues, growing under normal conditions. Total RNA was extracted as described in Example 2 above. Production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.) which are well known to those skilled in the art. PCR products were purified using PCR purification kit (Qiagen). In case where the entire coding sequence was not found, RACE kit from Ambion (RACE=_R_apid_A_ccess to _c_DNA_E_nds) was used to access the full cDNA transcript of the gene from the RNA samples described above. The RACE procedure was performed for the genes BDL-108 (SEQ ID NO:726), BDL-110 (SEQ ID NO:728) and BDL-111 (SEQ ID NO:730) using the primers sequences listed in Table 12, below. RACE products were cloned into high copy vector followed by sequencing. The information from the RACE procedure was used for cloning of the full length ORF of the corresponding genes.

TABLE 12

RACE primers used for sequencing of the identified genes of the invention

| Gene Name | Primers used for amplification | High copy plasmid used for cloning of RACE products |
|---|---|---|
| BDL108_Race | Fwd: BDL108_Outer_Race (SEQ ID NO: 853): GCTATACAACATGGGAGTTATACC | Topo TA |
| BDL108_Race | Fwd: BDL108_Inner_Race (SEQ ID NO: 854): CTATCGACAGTGCTGGTACA | |
| BDL108_Race | Rev: 3' Race Outer Primer (SEQ ID NO: 855): GCGAGCACAGAATTAATACGACT | |
| BDL108_Race | Rev: 3' Race Inner Primer (SEQ ID NO: 856): CGCGGATCCGAATTAATACGACTCACTATAGG | |
| BDL110_Race | Fwd: BDL110_Outer_Race (SEQ ID NO: 857): TGCAGTCTAAATACGATGGATCA | Topo TA |
| BDL110_Race | Fwd: BDL110_Inner_Race (SEQ ID NO: 858): GAGTAGGAACACTTACATTCGA | |
| BDL110_Race | Rev: 3' Race Outer Primer (SEQ ID NO: 859): GCGAGCACAGAATTAATACGACT | |
| BDL110_Race | Rev: 3' Race Inner Primer(SEQ ID NO: 860): CGCGGATCCGAATTAATACGACTCACTATAGG | |
| BDL111_Race | Fwd: BDL111_Outer_Race (SEQ ID NO: 861): TCTCAAGAAGCTCTTCGTGGA | Topo TA |
| BDL111_Race | Fwd: BDL111_Inner_Race (SEQ ID NO: 862): GAGGAAGAATCTGAGCCGAT | |
| BDL111_Race | Rev: 3' Race Outer Primer (SEQ ID NO: 863): GCGAGCACAGAATTAATACGACT | |
| BDL111_Race | Rev: 3' Race Inner Primer (SEQ ID NO: 864): CGCGGATCCGAATTAATACGACTCACTATAGG | |

Table 12. Provided are the PCR primers used for RACE sequencing. Fwd = forward primer; Rev = reverse primer;

In case genomic DNA was cloned, as in the case of BDL119 gene, the gene was amplified by direct PCR on genomic DNA extracted from leaf tissue using the DNEASY® (QIAGEN GmbH) kit (Qiagen Cat. No. 69104).

Usually, 2 sets of primers were synthesized for the amplification of each gene from a cDNA or a genomic sequence; an external set of primers and an internal set (nested PCR primers). When needed (e.g., when the first PCR reaction did not result in a satisfactory product for sequencing), an additional primer (or two) of the nested PCR primers were used. Table 13 below provides primers used for cloning of selected genes.

TABLE 13

The PCR primers used for cloning the genes of the invention

| Gene Name | Restriction Enzymes used for cloning | Primers used for amplification |
|---|---|---|
| BDL42 | SalI, XbaI | Fwd Nested: BDL42_NF_SalI (SEQ ID NO: 865) AATGTCGACAGAAAATGGGAGTCATGATCAA<br>Fwd External: BDL42_EF_SalI (SEQ ID NO: 866) AATGTCGACTGCTATAGAAAATGGGAGTCATG<br>Rev Nested: BDL42_NR_XbaI (SEQ ID NO: 867) TATCTAGATCATCAAACGGTTTCAGGACGAG<br>Rev External: BDL42_ER_XbaI (SEQ ID NO: 868) TATCTAGATGACACTTCAAACGGTTTCAG |
| BDL46 | SalI, SmaI | Fwd Nested: BDL46_NF_SalI (SEQ ID NO: 869) ACGGTCGACACTTGATGACAATGGGCGAC<br>Rev Nested: BDL46_NR_SmaI (SEQ ID NO: 870) TCCCGGGTTATTACCTACAAGTAGATGATTCTACACC |
| BDL51 | XbaI, SacI | Fwd: BDL51_F_XbaI (SEQ ID NO: 871) AATCTAGATCTCAATGGCTTCTAATTACCG<br>Rev Nested: BDL51_NR_SacI (SEQ ID NO: 872) AGAGCTCGTGTCTTACTCACATCCCTTGG |

TABLE 13-continued

The PCR primers used for cloning the genes of the invention

| Gene Name | Restriction Enzymes used for cloning | Primers used for amplification |
|---|---|---|
| | | Rev External: BDL51_ER_SacI (SEQ ID NO: 873) TGAGCTCTGCCACGTGTCTTACTCACATC |
| BDL52 | SalI, XbaI | Fwd: BDL52_F_SalI (SEQ ID NO: 874) AATGTCGACCTATAATGGCTGGAATGTGTTG Rev Nested: BDL52_NR_XbaI (SEQ ID NO: 875) TATCTAGATTACCCATACTGTTATAGATTTTTTCTC Rev External: BDL52_ER_XbaI (SEQ ID NO: 876) TATCTAGACATCAACAAAGGCAGCTAAATC |
| BDL54 | SalI, XbaI | Fwd Nested: BDL54_NF_SalI (SEQ ID NO: 877) AATGTCGACAAACAATGGCGAATAAGTTCAC Rev Nested: BDL54_NR_XbaI (SEQ ID NO: 878) TATCTAGATCATCAAGAAAACAACGCTTCG |
| BDL56 | SalI, XbaI | Fwd Nested: BDL56_NF_SalI (SEQ ID NO: 879) AGCGTCGACCAAATATGACTGTGATGAATCACC Fwd External: BDL56_EF_SalI (SEQ ID NO: 880) ATAGTCGACAAAGAGATCTTCACAAATATGACTG Rev Nested: BDL56_NR_XbaI (SEQ ID NO: 881) TATCTAGACTACTATCTCTTATAAGTTGCAACCAAG Rev External: BDL56_ER_XbaI (SEQ ID NO: 882) TATCTAGAATAGAAATGGCAAAATGGGTG |
| BDL59 | SalI, XbaI | Fwd Nested: BDL59_NF_SalI (SEQ ID NO: 883) AATGTCGACCTGCAATGGCTTCTCCTCTT Fwd External: BDL59_EF_SalI (SEQ ID NO: 884) TAAGTCGACGATCTCTCTCTGCACTCTCTGAC Rev Nested: BDL59_NR_XbaI (SEQ ID NO: 885) TATCTAGATCAATCTCAGACTCGAACGCGTG Rev External: BDL59_ER_XbaI (SEQ ID NO: 886) TATCTAGACTTCAACAATCTCAGACTCGAAC |
| BDL60 | SalI, SacI | Fwd Nested: BDL60_NF_SalI (SEQ ID NO: 887) AGAGCTCAGGAAAATGACAGAATCGAGTC Fwd External: BDL60_EF_SalI (SEQ ID NO: 888) AATGTCGACGGAGAGGTTACTGATCTGAATTG Rev Nested: BDL60_NR_SacI (SEQ ID NO: 889) AGAGCTCAGGAAAATGACAGAATCGAGTC Rev External: BDL60_ER_SacI (SEQ ID NO: 890) TGAGCTCAGCTTAGGTGTATGAACATTCTG |
| BDL65 | SalI, SmaI | Fwd Nested: BDL65_NF_SalI (SEQ ID NO: 891) AATGTCGACTCCAATTCCATCTTCCCATG Fwd External: BDL65_EF_SalI (SEQ ID NO: 892) AATGTCGACCTCTCCTCTGCTCTCCAATTC Rev Nested: BDL65_NR_SmaI (SEQ ID NO: 893) TCCCGGGTCATCATTCGAGGATCGTCCCA Rev External: BDL65_ER_SmaI (SEQ ID NO: 894) TCCCGGGCTTATAATCATTCGAGGATCGT |
| BDL67 | SalI, SmaI | Fwd Nested: BDL67_NF_SalI (SEQ ID NO: 895) AATGTCGACGGATAATGGCTTCGTATGGC Rev Nested: BDL67_NR_SmaI (SEQ ID NO: 896) TCCCGGGTTATCAGTTTCTCTTGGCGATGA |
| BDL68 | SalI, XbaI | Fwd Nested: BDL68_NF_SalI (SEQ ID NO: 897) TAGGTCGACTAGCCATGGACAACGAAGG Rev Nested: BDL68_NR_XbaI (SEQ ID NO: 898) TATCTAGATTATTAGCCACTAGGATTATCAAGTC |
| BDL78 | XbaI, SacI | Fwd: BDL78_F_XbaI (SEQ ID NO: 899) AATCTAGATCCGATCATGCCGACCAG Rev Nested: BDL78_NR_SacI-new (SEQ ID NO: 900) TGAGCTCTTATCAGTAATCGGTGGTAGGCA Rev External: BDL78_ER_SacI (SEQ ID NO: 901) TGAGCTCCAGATTAACAACGTTGAATTTGAC |
| BDL82 | SalI, XbaI | Fwd Nested: BDL82_NF_SalI (SEQ ID NO: 902) AAGGTCGACCGAGAGAGACAGAGAGGTTTCG Fwd External: BDL82_EF_SalI (SEQ ID NO: 903) ATAGTCGACCGAAGTTTGAGCTAAGAATCC Rev Nested: BDL82_NR_XbaI (SEQ ID NO: 904) TATCTAGATTATTATTCTCCATGGTCGTGAAG |

TABLE 13-continued

The PCR primers used for cloning the genes of the invention

| Gene Name | Restriction Enzymes used for cloning | Primers used for amplification |
|---|---|---|
| | | Rev External: BDL82_ER_XbaI (SEQ ID NO: 905) TATCTAGATAGCTATTATTCTCCATGGTCG |
| BDL89 | SalI, XbaI | Fwd Nested: BDL89_NF_SalI (SEQ ID NO: 906) AATGTCGACCCAGGATGAAGTTCATTTCTG<br>Fwd External: BDL89_EF_SalI (SEQ ID NO: 907) AATGTCGACTCTCTCCATCTCCCATCCAG<br>Rev Nested: BDL89_NR_XbaI (SEQ ID NO: 908) TATCTAGATCATCGCATCACTCAGTCAAACAAAC<br>Rev External: BDL89_ER_XbaI (SEQ ID NO: 909) TATCTAGAGATGATAGAAGAGGTGACCGC |
| BDL95Short | SalI, SacI | Fwd: BDL95_Short_F (SEQ ID NO: 910) AATGTCGACGGCGAATGGCTGGATTTC<br>Rev Nested: BDL95_NR_SacI (SEQ ID NO: 911) TGAGCTCTTATCAGTCCTGATGTGTCTGCTG |
| BDL100 | SalI, SacI | Fwd Nested: BDL100_NF_SalI (SEQ ID NO: 912) AATGTCGACAACAATGGAGAGCGAGATGGCG<br>Fwd External: BDL100_EF_SalI (SEQ ID NO: 913) AATGTCGACGAGGAGGAACAAACAACTCATC<br>Rev Nested: BDL100_NR_SacI (SEQ ID NO: 914) TGAGCTCTCATCATTGAATCATCGGATCACC<br>Rev External: BDL100_ER_sacI (SEQ ID NO: 915) TGAGCTCGCAGGTCATTGAATCATCGG |
| BDL106 | XbaI, SacI | Fwd Nested: BDL106_NF_XbaI (SEQ ID NO: 916) ATTCTAGAAAACCATGACCGTCGTCTC<br>Fwd External: BDL106_EF_XbaI (SEQ ID NO: 917) CTTCTAGAGGTCTCTTCTCAGATACTCATTCAC<br>Rev Nested: BDL106_NR_SacI (SEQ ID NO: 918) TGAGCTCTTATTAGAATCTGCAGAAAGCTAG<br>Rev External: BDL106_ER_SacI (SEQ ID NO: 919) TGAGCTCAGATGTCAAAGAGGGCTTACTC |
| BDL108 | SalI, XbaI | Fwd Nested: BDL108_NF_SalI (SEQ ID NO: 920) AATGTCGACCAGTGATGAGGAAGCTCAAGA<br>Fwd External: BDL108_EF_SalI (SEQ ID NO: 921) ATAGTCGACCGTTGTTTGCACCACCTTG<br>Rev Nested: BDL108_NR_XbaI (SEQ ID NO: 922) TATCTAGATTATTAAGCAAGCATGTCGTAGTCA<br>Rev External: BDL108_ER_XbaI (SEQ ID NO: 923) TCTCTAGATTAGATCTTTTAAGCAAGCATGTCG |
| BDL110 | SalI, XbaI | Fwd Nested: BDL110_NF_SalI (SEQ ID NO: 924) ACGGTCGACTCCACATGACTTCAGATGCTC<br>Fwd External: BDL110_EF_SalI (SEQ ID NO: 925) ACTGTCGACGAACATCACCCAATTCTCTAGC<br>Rev Nested: BDL110_NR_xbaI (SEQ ID NO: 926) TATCTAGACTACTAGCCGGTGACAAAGTAATC<br>Rev External: BDL110_ER_XbaI (SEQ ID NO: 927) TATCTAGACTAATCGTTGGTTGATGTGTCACTCTAG |
| BDL111 | EcoRV | Fwd Nested: BDL111_NF_EcoRV(SEQ ID NO: 928) TAGATATCAAAAGATGCAAGTTGTTTCTCC<br>Fwd External: BDL111_EF_EcoRV (SEQ ID NO: 929) TAGATATCCTGTGTGTTTGTATTTATTTGGATC<br>Rev Nested: BDL111_NR_EcoRV(SEQ ID NO: 930) TAGATATCTCATGATGATCAGTAAGGATGAACATTC<br>Rev External: BDL111_ER_EcoRV (SEQ ID NO: 931) TAGATATCTCAGCAAGAAGGTGATGATCAGTAAGG |
| BDL112 | SalI, XbaI | Fwd Nested: BDL112_NF_SI (SEQ ID NO: 932) TTGGTCGACCGTAGACACGTATTTTGAAGGG<br>Fwd External: BDL112_EF_SI (SEQ ID NO: 933) TATGTCGACTTAATGGTAGACCGTAGACACG<br>Rev Nested: BDL112_NR_Xb (SEQ ID NO: 934) CAATCTAGATTAATGCTCTCAAGAGACACAATAAGC<br>Rev External: BDL112_ER_Xb (SEQ ID NO: 935) CTTCTAGATTAGGTCATCAAATATTGTATAGATCG |

TABLE 13-continued

The PCR primers used for cloning the genes of the invention

| Gene Name | Restriction Enzymes used for cloning | Primers used for amplification |
|---|---|---|
| BDL113_GA | SacI, XbaI | Synthetic product |
| BDL114 | SalI, XbaI | Fwd: BDL114_NF_SI(SEQ ID NO: 936) TTTGTCGACTCAGCTTCAGATGGTGATTCC Rev: BDL114_NR_Xb (SEQ ID NO: 937) TTTCTAGATCATCAGAGCAACTTGACACCAGC |
| BDL115 | SmaI, SacI | Fwd Nested: BDL115_NF_SmaI (SEQ ID NO: 938) ACCCGGGAGAAGATGAAGCTAAAATGGGAA Fwd External: BDL115_EF_SmaI (SEQ ID NO: 939) ACCCGGGGTATATCTCTCAGCGCGAGG Rev Nested: BDL115_NR_SacI (SEQ ID NO: 940) TGAGCTCTTATTATTTACCGGTTCGACCATT Rev External: BDL115_ER_SacI (SEQ ID NO: 941) TGAGCTCTTAGCCATTGACTACATACAAGCAA |
| BDL116 | EcoRV | Fwd Nested: BDL116_NF_EcRV (SEQID NO: 942 TAGATATCACCTTGGAACGATTTTGCC Fwd External: BDL116_EF_EcRV (SEQ ID NO: 943) GAGATATCAAAGCTCTGACCTTGGAACG Rev Nested: BDL116_NR_EcRV (SEQ ID NO: 944) CAGATATCTTATCATAAGTACAAATCAGTCTGCTCAC Rev External: BDL116_ER_EcRV(SEQ ID NO: 945) TAGATATCTCACATTCATAAGTACAAATCAGTCTGC |
| BDL119 | EcoRV | Fwd: BDL119_NF_EcRV (SEQ ID NO: 946) TTGATATCAGTTTCTCCGTCGACGATACC Rev: BDL119_NR_EcRV (SEQ ID NO: 947) AAGATATCGGTCAAGTACATAAGCTAATAGATG |
| BDL120 | SacI, SalI | Fwd: BDL120_F_SalI (SEQ ID NO: 948) AATGTCGACAACAATGGTGCTTCTACTTGTGATTG Rev: BDL120_R_SacI (SEQ ID NO: 949) TGAGCTCTCACTTCCACTAGTCACTACAAGCG |
| BDL122 | SalI, XbaI | Fwd: BDL122_NF_SI (SEQ ID NO: 950) CTGGTCGACACAGTATTGAGAGACTTCCTGGTG Rev: BDL122_NR_Xba (SEQ ID NO: 951) GCTTCTAGACAATGTGAACTAAATCGACC |
| BDL123 | SacI | Fwd: BDL123_F_Sac (SEQ ID NO: 952) AGAGCTCGTTTTCTTCGCCATGGC Rev: BDL123_R_Sac (SEQ ID NO: 953) TGAGCTCTTAAACAGTGACTACCACAGTGCA |
| BDL124 | EcoRV | Fwd Nested: BDL124_NF_EcRV (SEQ ID NO: 954) TCGATATCGGAATCAGAATCTTTTCAGATGG Fwd External: BDL124_EF_EcRV (SEQ ID NO: 955) CTGATATCGAGTTTCTCTTCCTTAATTGTCG Rev Nested: BDL124_NR_EcRV (SEQ ID NO: 956) TTGATATCATCATCAGCTTGGAACCTCG Rev External: BDL124_ER_EcRV (SEQ ID NO: 957) TAGATATCTCTTTCCATCGATCATCAGC |
| BDL125 | SalI, XbaI | Fwd: BDL125_NF_SI (SEQ ID NO: 958) CTAGTCGACTAACAACAATGGAGAACCCTC Rev: BDL125_NR_Xb (SEQ ID NO: 959) ACTCTAGATTAATGATCAACCAATTGGTCTTAG |
| BDL127_GA | SacI, XbaI | Synthetic product |
| BDL128 | XbaI | Fwd: BDL128_NF_XbaI (SEQ ID NO: 960) TATCTAGAAGAAAATGGCGATGCGAC Rev: BDL128_NR_XbaI (SEQ ID NO: 961) TATCTAGATCATCACACATCCTGAGATACTTCATC |
| BDL129_GA | SacI, XbaI | Synthetic product |
| BDL130_GA | SacI, XbaI | Synthetic product |

TABLE 13-continued

The PCR primers used for cloning the genes of the invention

| Gene Name | Restriction Enzymes used for cloning | Primers used for amplification |
|---|---|---|
| BDL131 | SalI, XbaI | Fwd: BDL131_NF_SalI (SEQ ID NO: 962)<br>AATGTCGACAGAGAAATGTTGGCTATCTTCC<br>Rev: BDL131_NR_XbaI (SEQ ID NO: 963)<br>TATCTAGATCATCAGAGAGACCAATTGGCTTC |
| BDL132 | SalI, XbaI | Fwd Nested: BDL132_NF_SalI (SEQ ID NO: 964)<br>AATGTCGACTTTGAATGGAACCATCATCTG<br>Fwd External: BDL132_EF_SalI (SEQ ID NO: 965)<br>TTAGTCGACCTGAATCTGTTTTTGAATGGAAC<br>Rev Nested: BDL132_NR_XbaI (SEQ ID NO: 966)<br>TATCTAGATTATTAGGTGGAAAGAACAAGCG<br>Rev External: BDL132_ER_XbaI (SEQ ID NO: 967)<br>TATCTAGATCAACAAGACAAGATAATGAAAGACACAG |
| BDL133 | EcoRV | Fwd: BDL133_NF_EcoRV(SEQ ID NO: 968)<br>TAGATATCTTAAAATGCCGGAGAAAGG<br>Rev: BDL133_NR_EcoRV (SEQ ID NO: 969)<br>ATGATATCCTACTATCTTACACACAATGCATTCAG |
| BDL134_GA | SacI, XbaI | Synthetic product |
| BDL135 | SalI, XbaI | Fwd: BDL135_NF_SalI (SEQ ID NO: 970)<br>ATAGTCGACGAAACATGGTTGAATCGGAC<br>Rev: BDL135_NR_XbaI (SEQ ID NO: 971)<br>TATCTAGATTAGACACTTTATGCCTCCTTTGTAG |
| BDL136 | SalI, SacI | Fwd: BDL136_NF_SI (SEQ ID NO: 972)<br>AGCGTCGACTTAGAGAGAGATGCAGAAACGG<br>Rev: BDL136_NR_Sc (SEQ ID NO: 973)<br>CGAGCTCCTAATCTAGAGAAGACTTTTACATGCC |
| BDL137_GA | SacI, XbaI | Synthetic product |
| BDL139_GA | SacI, XbaI | Synthetic product |
| BDL141_GA | SacI, XbaI | Synthetic product |
| BDL142 | SalI, XbaI | Fwd Nested: BDL142_NF_SalI (SEQ ID NO: 974)<br>AATGTCGACCATCCTCATGAATAATTCTACATC<br>Fwd External: BDL142_EF_SalI (SEQ ID NO: 975)<br>ACTGTCGACGCATTCCATTCATCCTCATGA<br>Rev Nested: BDL142_NR_Xba (SEQ ID NO: 976)<br>ATTCTAGAGTGTGATTATCAGTTTGTTCTCTC<br>Rev External: BDL142_ER_XbaI (SEQ ID NO: 977)<br>ATTCTAGAGAAACGACAAGTGATTATAATGG |
| BDL143 | SalI, BamHI | Fwd: BDL143_F_SalI (SEQ ID NO: 978)<br>ACTGTCGACAACATGTTGTTTAACTGGACTAAG<br>Rev Nested: BDL143_NR_BamHI (SEQ ID NO: 979)<br>ATGGATCCTTACAGAACCGGTCAAGATGAAG<br>Rev External: BDL143_ER_BamHI (SEQ ID NO: 980)<br>ATGGATCCCAATAACTCGAACACGAACAAC |
| BDL144 | EcoRV | Fwd: BDL144_F_EcoRV (SEQ ID NO: 981)<br>TAGATATCAACAATGATTACAGTAGCCCCCTTC<br>Rev Nested: BDL144_NR_EcoRV (SEQ ID NO: 982)<br>ATGATATCCTAACAAGCACAAGACTGATACAGC<br>Rev External: BDL144_ER_EcoRV (SEQ ID NO: 983)<br>ATGATATCCAAAAGCTAGCTACTAGTTTCATCAC |
| BDL145 | SalI, XbaI | Fwd: BDL145_F_Sal (SEQ ID NO: 984)<br>ATAGTCGACGAAAGAAAGAGAAAGCAGAACATG<br>Rev: BDL145_NR_XbaI (SEQ ID NO: 985)<br>ATTCTAGATGGAGGAGCAAATACAAACTTG |
| BDL146 | SalI, XbaI | Fwd: BDL146_F_SalI (SEQ ID NO: 986)<br>AATGTCGACGAAACTTGGTTTTGAGCTTAAC<br>Rev Nested: BDL146_NR_XbaI (SEQ ID NO: 987)<br>ATTCTAGATCATCCCATTGCTTTCTCTAGTATTAG<br>Rev External: BDL146_ER_XbaI (SEQ ID NO: 988)<br>ATTCTAGATTAAATGTATCGCTCCAAAAGAC |

TABLE 13-continued

The PCR primers used for cloning the genes of the invention

| Gene Name | Restriction Enzymes used for cloning | Primers used for amplification |
|---|---|---|
| BDL148 | SalI, SacI | Fwd Nested: BDL148_NF_SalI (SEQ ID NO: 989) ACTGTCGACCTAATTCTCTCCGTCTCGATCG<br>Fwd External: BDL148_EF_SalI (SEQ ID NO: 990) ACTGTCGACGACTGATTTTACGCTTTATTGCTC<br>Rev Nested: BDL148_NR_NEW_SacI (SEQ ID NO: 991) GTGAGCTCTTAAACAGGTCATCTCGAGCCAC<br>Rev External: BDL148_ER_NEW_SacI (SEQ ID NO: 992) GAGAGCTCCGTTGCCTGACAGAATCTTTG |

Table 13. Provided are the PCR primers used for cloning the genes described in Table 12 above. Fwd = forward primer; Rev = reverse primer; Nested = nested primer for PCR (internal primer); External = external primer for PCR.

Sequencing of the amplified PCR products was performed, using ABI 377 sequencer (Amersham Biosciences Inc). To facilitate cloning of the cDNAs/genomic sequences, a 8-12 bp extension was added to the 5' of each primer. The primer extension includes an endonuclease restriction site. The restriction sites were selected using two parameters: (a). The site did not exist in the cDNA sequence; and (b). The restriction sites in the forward and reverse primers were designed such that the digested cDNA is inserted in the sense formation into the binary vector utilized for transformation.

PCR products were digested with the restriction endonucleases (New England BioLabs Inc) according to the sites design in the primers (Table 13, above) and cloned into binary vectors according to Table 14, below. RACE products were sequenced as described hereinbelow for BDL108, BDL 110 and BDL111.

TABLE 14

Restriction enzyme sites used to clone the identified genes into binary vector

| Gene name | Binary vector | Restriction enzymes used for cloning into binary vector-FORWARD | Restriction enzymes used for cloning into binary vector-REVERSE | Restriction enzymes used for digesting the binary vector |
|---|---|---|---|---|
| BDL42 | pBXYN | SalI | EcoRI | SalI, EcoRI |
| BDL46 | pBXYN | SalI | SmaI | SalI, Ecl136 |
| BDL51 | pBXYN | SalI | EcoRI | SalI, EcoRI |
| BDL52 | pBXYN | SalI | EcoRI | SalI, EcoRI |
| BDL54 | pBXYN | SalI | EcoRI | SalI, EcoRI |
| BDL56 | pBXYN | SalI | EcoRI | SalI, EcoRI |
| BDL59 | pBXYN | SalI | EcoRI | SalI, EcoRI |
| BDL60 | pBXYN | SalI | EcoRI | SalI, EcoRI |
| BDL65 | pBXYN | SalI | SmaI | SalI, Ecl136 |
| BDL67 | pBXYN | SalI | SmaI | SalI, Ecl136 |
| BDL68 | pBXYN | SalI | SmaI | SalI, Ecl136 |
| BDL78 | pBXYN | SalI, | EcoRI | SalI, EcoRI |
| BDL82 | pBXYN | SalI | EcoRI | SalI, EcoRI |
| BDL89 | pBXYN | SalI | EcoRI | SalI, EcoRI |
| BDL95 | pBXYN | SalI | EcoRI | SalI, EcoRI |
| BDL100 | pBXYN | SalI | SacI | SalI, SacI |
| BDL106 | pBXYN | SalI | EcoRI | SalI, EcoRI |
| BDL108 | pBXYN | SalI | EcoRI | SalI, EcoRI |
| BDL110 | pBXYN | SalI | EcoRI | SalI, EcoRI |
| BDL111 | pBXYN | EcoRV | EcoRV | SmaI, Ecl136 |
| BDL112 | pBXYN | SalI | EcoRI | SalI, EcoRI |
| BDL114 | pBXYN | SalI | EcoRI | SalI, EcoRI |
| BDL115 | pBXYN | SmaI | SacI | SmaI, SacI |
| BDL116 | pBXYN | EcoRV | EcoRV | SmaI, Ecl136 |
| BDL119 | pBXYN | EcoRV | EcoRV | SmaI, Ecl136 |
| BDL120 | pBXYN | SalI | SacI | SalI, SacI |
| BDL122 | pBXYN | SalI | EcoRI | SalI, EcoRI |
| BDL123 | pBXYN | SalI | EcoRI | SalI, EcoRI |
| BDL124 | pBXYN | EcoRV | EcoRV | SmaI, Ecl136 |
| BDL125 | pBXYN | SalI | EcoRI | SalI, EcoRI |
| BDL128 | pBXYN | SalI | EcoRI | SalI, EcoRI |
| BDL131 | pBXYN | SalI | EcoRI | SalI, EcoRI |
| BDL132 | pBXYN | SalI | EcoRI | SalI, EcoRI |
| BDL133 | pBXYN | EcoRV | EcoRV | SmaI, Ecl 136 II |
| BDL135 | pBXYN | SalI | EcoRI | SalI, EcoRI |
| BDL136 | pBXYN | SalI | EcoRI | SalI, EcoRI |
| BDL142 | pBXYN | SalI | EcoRI | SalI, EcoRI |
| BDL143 | pBXYN | BamHI | Sal I | SalI, Ecl 136 II |
| BDL144 | pBXYN | EcoRV | EcoRV | SmaI, Ecl 136 II |
| BDL145 | pBXYN | SalI | EcoRI | SalI, EcoRI |

TABLE 14-continued

| Restriction enzyme sites used to clone the identified genes into binary vector | | | | |
|---|---|---|---|---|
| Gene name | Binary vector | Restriction enzymes used for cloning into binary vector-FORWARD | Restriction enzymes used for cloning into binary vector-REVERSE | Restriction enzymes used for digesting the binary vector |
| BDL146 | pBXYN | SalI | EcoRI | SalI, EcoRI |
| BDL148 | pBXYN | SalI | EcoRI | SalI, EcoRI |
| BDL113_GA | pBXYN | SacI | Xba I | SacI, Xba I |
| BDL127_GA | pBXYN | SacI | Xba I | SacI, Xba I |
| BDL129_GA | pBXYN | SacI | Xba I | SacI, Xba I |
| BDL130_GA | pBXYN | SacI | Xba I | SacI, Xba I |
| BDL134_GA | pBXYN | SacI | Xba I | SacI, Xba I |
| BDL137_GA | pBXYN | SacI | Xba I | SacI, Xba I |
| BDL139_GA | pBXYN | SacI | Xba I | SacI, Xba I |
| BDL141_GA | pBXYN | SacI | Xba I | SacI, Xba I |

Table 14.

Each digested PCR product was inserted into a high copy vector pBlue-script KS plasmid vector [pBlue-script KS plasmid vector, stratagene (dot) com/manuals/212205 (dot) pdf] or into plasmids originating from these vectors. In cases where the pGXN high copy vector (originated from pBlue-script KS) was used, the PCR product was inserted upstream to the NOS terminator (SEQ ID NO:776) originated from pBI 101.3 binary vector (GenBank Accession No. U12640, nucleotides 4356 to 4693, SEQ ID NO:776) and downstream to the 35S promoter. In other cases (pKSJ_6669a), the At6669 promoter (SEQ ID NO:775) was already cloned into the pBlue-script KS so the gene was introduced downstream of the promoter (Table 15 below). In all cases, after confirmation of the sequence of the cloned genes, the cloned cDNA accompanied or not with the NOS terminator was introduced into the pGI binary vector [pBXYN containing the 35S CaMV promoter] according to Table 14, hereinabove, via digestion with an appropriate restriction endonucleases. In any case the insert was followed by single copy of the NOS terminator (SEQ ID NO:776).

TABLE 15

| Genes cloned from cDNA libraries or genomic DNA in a High copy number plasmid | | | | | |
|---|---|---|---|---|---|
| | High copy | Amplified from | | Polynucleotide | Polypeptide |
| Gene Name | plasmid | Organism | Origin | SEQ ID NO: | SEQ ID NO: |
| BDL42 | pGXN | *Arabidopsis* | mRNA | 692 | 86 |
| BDL46 | pKS | *Arabidopsis* | mRNA | 693 | 87 |
| BDL51 | pGXN | *Arabidopsis* | mRNA | 694 | 88 |
| BDL52 | pGXN | Tomato | mRNA | 695 | 713 |
| BDL54 | pGXN | *Arabidopsis* | mRNA | 696 | 90 |
| BDL56 | pGXN | *Arabidopsis* | mRNA | 697 | 91 |
| BDL59 | pGXN | *Arabidopsis* | mRNA | 698 | 92 |
| BDL60 | pGXN | *Arabidopsis* | mRNA | 699 | 93 |
| BDL65 | pKS | *Arabidopsis* | mRNA | 700 | 94 |
| BDL67 | pKS | *Arabidopsis* | mRNA | 701 | 714 |
| BDL68 | pKS | *Arabidopsis* | mRNA | 702 | 96 |
| BDL78 | pGXN | *Arabidopsis* | mRNA | 703 | 97 |
| BDL82 | pGXN | *Arabidopsis* | mRNA | 704 | 98 |
| BDL89 | pGXN | Rice | mRNA | 705 | 99 |
| BDL95 | pGXN | Rice | mRNA | 706 | 715 |
| BDL100 | pGXN | Rice | mRNA | 657 | 707 |
| BDL106 | pGXN | Canola | mRNA | 658 | 52 |
| BDL108 | pGXN | Canola | mRNA | 659 | 708 |
| BDL110 | pGXN | Canola | mRNA | 660 | 709 |
| BDL111 | pKSJ_6669a | Canola | mRNA | 661 | 710 |
| BDL112 | pGXN | *Arabidopsis* | mRNA | 662 | 56 |
| BDL114 | pGXN | *Arabidopsis* | mRNA | 664 | 58 |
| BDL115 | pKSJ | *Arabidopsis* | mRNA | 665 | 59 |
| BDL116 | pKSJ_6669a | *Arabidopsis* | mRNA | 666 | 60 |
| BDL119 | pKSJ_6669a | *Arabidopsis* | Genomic DNA | 667 | 711 |
| BDL120 | pGXN | *Arabidopsis* | mRNA | 668 | 62 |
| BDL122 | pGXN | *Arabidopsis* | mRNA | 669 | 63 |
| BDL123 | pGXN | *Arabidopsis* | mRNA | 670 | 64 |
| BDL124 | pKSJ_6669a | *Arabidopsis* | mRNA | 671 | 65 |
| BDL125 | pGXN | *Arabidopsis* | mRNA | 672 | 66 |
| BDL128 | pGXN | *Arabidopsis* | mRNA | 674 | 68 |
| BDL131 | pGXN | *Arabidopsis* | mRNA | 677 | 71 |
| BDL132 | pGXN | *Arabidopsis* | mRNA | 678 | 72 |
| BDL133 | pKSJ_6669a | *Arabidopsis* | mRNA | 679 | 73 |
| BDL135 | pGXN | *Arabidopsis* | mRNA | 681 | 75 |
| BDL136 | pGXN | *Arabidopsis* | mRNA | 682 | 76 |

TABLE 15-continued

| Genes cloned from cDNA libraries or genomic DNA in a High copy number plasmid | | | | | |
|---|---|---|---|---|---|
| | High copy | Amplified from | | Polynucleotide | Polypeptide |
| Gene Name | plasmid | Organism | Origin | SEQ ID NO: | SEQ ID NO: |
| BDL142 | pGXN | *Arabidopsis* | mRNA | 686 | 80 |
| BDL143 | pKSJ | *Arabidopsis* | mRNA | 687 | 81 |
| BDL144 | pKSJ_6669a | *Arabidopsis* | mRNA | 688 | 82 |
| BDL145 | pGXN | *Arabidopsis* | mRNA | 689 | 83 |
| BDL146 | pGXN | *Arabidopsis* | mRNA | 690 | 84 |
| BDL148 | pGXN | *Arabidopsis* | mRNA | 691 | 85 |
| BDL113_GA | pGA4 | Synthetic | GeneArt | 663 | 57 |
| BDL127_GA | pCR4Blunt-TOPO | Synthetic | GeneArt | 673 | 67 |
| BDL129_GA | pGA4 | Synthetic | GeneArt | 675 | 69 |
| BDL130_GA | pGA14 | Synthetic | GeneArt | 676 | 712 |
| BDL134_GA | pGA4 | Synthetic | GeneArt | 680 | 74 |
| BDL137_GA | pGA18 | Synthetic | GeneArt | 683 | 77 |
| BDL139_GA | pGA15 | Synthetic | GeneArt | 684 | 78 |
| BDL141_GA | pGA4 | Synthetic | GeneArt | 685 | 79 |

Table 15: Cloned and synthetic genes are provided along with the sequence identifiers of their polynucleotides and polypeptides. Also provided are the source organism, tissue and the cloning vectors.

Figure 3:
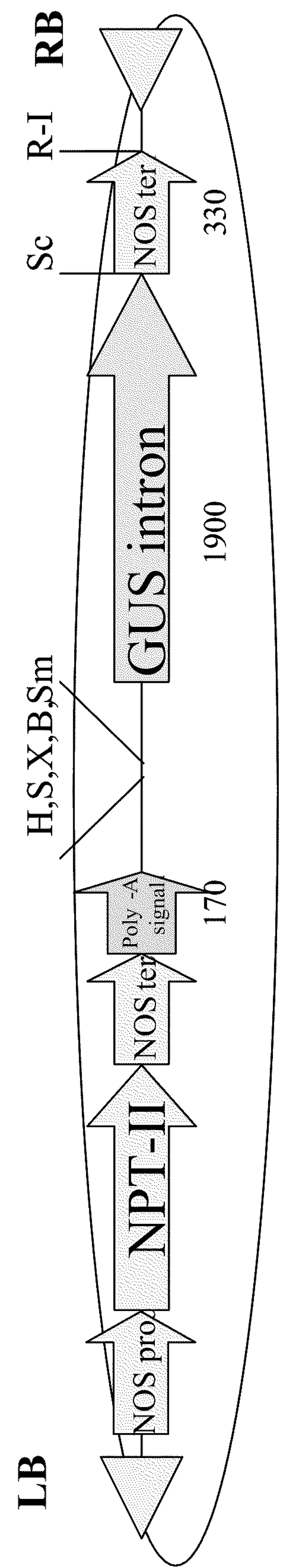
FIG. 3 is a schematic illustration of the pGI binary plasmid used for expressing the isolated polynucleotide sequences of the invention. RB—T-DNA right border; LB—T-DNA left border; H—HindIII restriction enzyme; X—XbaI restriction enzyme; B—BamHI restriction enzyme; S—SaiI restriction enzyme; Sm—SmaI restriction enzyme; R-I—EcoRI restriction enzyme; Sc—SacI/SstI/Ecl136II; (numbers)—Length in base-pairs; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of some embodiments of the invention were cloned into the vector while replacing the GUSintron reporter gene.

The digested products and the linearized plasmid vector were ligated using T4 DNA ligase enzyme (Roche, Switzerland). The plasmid pPI was constructed by inserting a synthetic poly-(A) signal sequence, originating from pGL3 basic plasmid vector (Promega, Acc No U47295; by 4658-4811) into the HindIII restriction site of the binary vector pBI101.3 (Clontech, Acc. No. U12640). pGI (FIG. 3) is similar to pPI, but the original gene in the backbone, the GUS gene, was replaced by the GUS-Intron gene followed by the NOS terminator (SEQ ID NO:776) (Vancanneyt. G, et al MGG 220, 245-50, 1990). pGI was used to clone the polynucleotide sequences, initially under the control of 35S promoter [Odell, J T, et al. Nature 313, 810-812 (28 Feb. 1985); SEQ ID NO:777.

Selected DNA sequences were synthesized by a commercial supplier GeneArt, GmbH [geneart (dot) com/)]. Synthetic DNA is designed in silico. Suitable restriction enzymes sites were added to the cloned sequences at the 5' end and at the 3' end to enabled later cloning into the pBXYN binary downstream of the CaMV 35S promoter (SEQ ID NO: 777).

Optimization of genes for expression in dicotyledonous plants—To optimize the coding sequence (in silico design), codon-usage Tables calculated from plant transcriptions were used [example of such Tables can be found in the Codon Usage Database available online at kazusa (dot) or (dot) jp/codon/]. The optimized coding sequences were designed in a way that no changes are introduced in the encoded amino acid sequence (of selected polypeptides from Table 1, Example 1) while using codons preferred for expression in dicotyledonous plants mainly *Arabidopsis*, Tomato, Canola and Soya while avoiding rare codons for Arabidopsis; and monocotyledonous plants such as maize. Such optimized sequences promote better translation rate and therefore higher protein expression levels. The genes for which codon optimized synthetic (artificial) sequences were prepared are: BDL-113 (SEQ ID NO:663 polynucleotide, SEQ ID NO:57 polypeptide), BDL-127 (SEQ ID NO:673 polynucleotide, SEQ ID NO:67 polypeptide), BDL-129 (SEQ ID NO:675 polynucleotide, SEQ ID NO:69 polypeptide), BDL-130 (SEQ ID NO:676 polynucleotide, SEQ ID NO:712 polypeptide), BDL-134 (SEQ ID NO:680 polynucleotide, SEQ ID NO:74 polypeptide), BDL-137 (SEQ ID NO:683 polynucleotide, SEQ ID NO:77 polypeptide), BDL-139 (SEQ ID NO:684 polynucleotide, SEQ ID NO:78 polypeptide), BDL-141 (SEQ ID NO:685 polynucleotide, SEQ ID NO:79 polypeptide).

Several polynucleotide sequences of the selected genes were cloned downstream of the CaMV 35S promoter (SEQ ID NO:777), the Arabidopsis At6669 promoter (SEQ ID NO:775) or the Napin seed specific promoter (SEQ ID NO:778).

The Napin (SEQ ID NO:778) promoter, which originates from *Brassica napus*, is characterized by a seed specific promoter activity [Stuitje A. R. et. al. Plant Biotechnology Journal 1 (4): 301-309]. The Napin promoter was amplified by direct PCR on genomic DNA extracted from leaf tissue [using the DNAeasy kit (Qiagen Cat. No. 69104)] using the following PCR primers: Napin F HindIII 5'-ATAAGCTTATTGATTCCTTTAAAGACTTATGTT (SEQ ID NO:993) and Napin R SalI 5'-TCGTCGACGGGTGTATGTTTTTAATCTTGTTT (SEQ ID NO:994). An example of a gene cloned downstream of the Napin promoter sequence is BDL65 (SEQ ID NO:700).

For 9 genes, namely BDL52, BDL67, BDL95, BDL100, BDL108, BDL110, BDL111, BDL119 and BDL130, the protein translation of the amplified cDNA sequence did not match the initial bioinformatics prediction of the protein sequences. The polypeptide sequences encoded by the cloned and their sequence identifiers are as follows: BDL52 (SEQ ID NO:713), BDL67 (SEQ ID NO:714), BDL95 (SEQ ID NO:715), BDL100 (SEQ ID NO:707), BDL108 (SEQ ID NO:708), BDL110 (SEQ ID NO:709), BDL111 (SEQ ID NO:710), BDL119 (SEQ ID NO:711) and BDL130 (SEQ ID NO:712). Note that the BDL119 gene is predicted to be a non-coding RNA (e.g., a regulatory RNA). The BDL119 polynucleotide was cloned from a genomic DNA and BDL119 cDNA is provided in SEQ ID NO:667.

Example 5

Producing Transgenic Arabidopsis Plants Expressing the Identified Polynucleotides of the Invention Materials and Experimental Methods Plant transformation—The *Arabidopsis thaliana* var Columbia ($T_0$ plants) were transformed according to the Floral Dip procedure [Clough S J, Bent A F. (1998) Floral dip: a simplified method for Agrobacterium-mediated transformation of *Arabidopsis thaliana*. Plant J. 16(6): 735-43; and Desfeux C, Clough S J, Bent A F. (2000) Female reproductive tissues are the primary targets of Agrobacterium-mediated transformation by the *Arabidopsis* floral-dip method. Plant Physiol. 123(3): 895-904] with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_o$ plants were ready for transformation six days before anthesis.

Single colonies of *Agrobacterium* carrying the binary vectors harboring the seed oil genes were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contained half-strength (2.15 g/L) Murashige-Skoog (Duchefa); 0.044 μM benzylamino purine (Sigma); 112 μg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the above ground plant tissue was submerged for 3-5 seconds. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ *Arabidopsis* plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 6

Identification of Novel Promoters

Constitutive promoters allow continuous expression of genes regulated thereby throughout the plant. A widely used example for a constitutive promoter is the CaMV35S promoter from cauliflower mosaic virus (SEQ ID NO:777).

One of the important requirements for an engineered plant is to activate the gene-of-interest in the right tissue or organ, and/or at the appropriate time (e.g., a certain developmental stage, under certain environmental conditions). For example, in order to influence a unique tissue such as seed, the gene-of-interest may be induced for expression (activated) at a certain developmental stage such as pre embryo fertilization, post fertilization, early or late embryogenesis. For example, to improve yield and/or oil content of a plant, the expression of the gene-of-interest may be regulated by a promoter having an expression pattern appropriate for seed development. Thus, the combination of a target gene with specific promoters such as developmental specific promoter (such as seed, carpel, stem, seedling) may increase the desired effect of the gene (e.g., improve yield and/or oil content) and may avoid undesired influence of the gene on other biological processes in other tissues, for example, cell structure, plant architecture.

The present inventors have isolated and validated novel developmental specific promoters from different stages of plant development and/or plant tissues, having different levels of gene expression. The following description summarizes the process of selection and cloning of the novel Arabidopsis promoters.

Cloning and analysis of promoters—The novel Arabidopsis promoters of the invention were selected based on the expression profile of the native genes positioned downstream (3') to the promoter sequences (see Table 16, below).

TABLE 16

| Expression profile based on microarray analysis | | | | | | | |
|---|---|---|---|---|---|---|---|
| Gene 3' to the promoter | AT1G30860 | AT2G31160 | AT2G39640 | AT3G21380 | AT3G24510 | AT3G61040 | AT4G15975 |
| Description of gene product | expressed protein | Protein of unknown function (DUF640) | Glycosyl hydrolase family 17 protein | similar to jacalin lectin family protein [*Arabidopsis thaliana*] (TAIR: At1g52040.1) | Encodes a defensin-like (DEFL) family protein | cytochrome P450 family protein | Zinc finger, C3HC4 type (RING finger) |
| Specificity/ normalized expression level | Seed | Stem | Seed | Seed | Carpel | Seed | Seedling |
| carpels | 28.89 | 6.89 | 35.03 | 50.33 | 462.3 | 23.75 | 16.29 |
| cauline | 58.82 | 26.06 | 18.62 | 8.48 | 4 | 40.36 | 4 |
| cotyledons | 27.56 | 35.91 | 30.1 | 4 | 4.59 | 36.86 | 39.32 |
| flower | 21.59 | 97.92 | 35.48 | 32.46 | 23.73 | 26.94 | 18.92 |
| hypocotyl | 48.59 | 782.8 | 30.62 | 31.39 | 6.32 | 27.57 | 31.21 |
| inflorescence | 23.93 | 643.83 | 24.23 | 39.18 | 4 | 32.95 | 4 |

TABLE 16-continued

| Expression profile based on microarray analysis | | | | | | | |
|---|---|---|---|---|---|---|---|
| Gene 3' to the promoter | AT1G30860 | AT2G31160 | AT2G39640 | AT3G21380 | AT3G24510 | AT3G61040 | AT4G15975 |
| leaf | 9.61 | 41.3 | 25 | 7.73 | 5.95 | 42.8 | 23.3 |
| pedicels | 4 | 12.22 | 22.78 | 13.35 | 4.12 | 39.68 | 20.16 |
| petals | 4 | 16 | 41.7 | 14 | 4.48 | 36.9 | 17.2 |
| petiole | 4 | 174.5 | 15.23 | 20.1 | 4 | 55.57 | 28.04 |
| pollen | 56.49 | 16.3 | 36.44 | 19.85 | 4 | 16.31 | 20.17 |
| root | 20 | 91.6 | 39 | 38.2 | 6.91 | 35.8 | 19.3 |
| rosette | 8.19 | 37.84 | 26.28 | 17.49 | 4.78 | 33.78 | 27.05 |
| seed | 1172.9 | 52.49 | 30.41 | 1702.9 | 10.89 | 1186.5 | 24.34 |
| seedling | 16.78 | 65.72 | 30.6 | 19.9 | 6.92 | 37.95 | 81.98 |
| sepals | 77.8 | 19.3 | 30 | 9.09 | 4 | 53.9 | 13.2 |
| shoot | 19.22 | 631.3 | 26.5 | 34.29 | 4.84 | 26.34 | 21.36 |
| siliques | 61.36 | 60.56 | 132.9 | 16.83 | 698.8 | 39.27 | 22.16 |
| stamen | 66.15 | 17.04 | 32.04 | 62.88 | 4 | 20.98 | 21.67 |
| stem | 24.18 | 449.5 | 18.17 | 15.99 | 6.77 | 38.93 | 5.62 |

Table 16. Provided are the results of a microarray expression profile of genes (GenBank Accession NOs.) positioned 3' of the identified promoters. Shown are the tissue specifcity of the promoters and the normalized expression levels of each gene in the specific tissue.

Table 17, hereinbelow, provides the sequence identifiers of the novel promoters of the invention, along with the sequence identifiers of the genes and the polypeptides encoded thereby positioned downstream of the novel promoters of the invention.

TABLE 17

| Identification of novel promoters | | | |
|---|---|---|---|
| Promoter designation (SEQ ID NO:) | The polynucleotides (GenBank Accession Nos. and SEQ ID NO:) positioned downstream of the identified promoters | The polypeptides (GenBank Accession Nos. and SEQ ID NO:) encoded by the polynucleotides positioned downstream of the identified promoters | Promoter length (bp) |
| PrBDL40 L (SEQ ID NO: 779) | AT1G30860 (SEQ ID NO: 793) | AT1G30860_P1 SEQ ID NO: 800 | 2970 |
| PrBDL40 S (SEQ ID NO: 780) | AT1G30860 (SEQ ID NO: 793) | AT1G30860_P1 SEQ ID NO: 800 | 2238 |
| PrBDL34 L (SEQ ID NO: 781) | AT2G31160 (SEQ ID NO: 794) | AT2G31160_P1 SEQ ID NO: 801 | 3097 |
| PrBDL34 S (SEQ ID NO: 782) | AT2G31160 (SEQ ID NO: 794) | AT2G31160_P1 SEQ ID NO: 801 | 3000 |
| PrBDL36 L (SEQ ID NO: 783) | AT2G39640 (SEQ ID NO: 795) | AT2G39640_P1 SEQ ID NO: 802 | 2889 |
| PrBDL36 S (SEQ ID NO: 784) | AT2G39640 (SEQ ID NO: 795) | AT2G39640_P1 SEQ ID NO: 802 | 831 |
| PrBDL38 L (SEQ ID NO: 785) | AT3G21380 (SEQ ID NO: 796) | AT3G21380_P1 SEQ ID NO: 803 | 3000 |
| PrBDL38 S (SEQ ID NO: 786) | AT3G21380 (SEQ ID NO: 796) | AT3G21380_P1 SEQ ID NO: 803 | 880 |
| PrBDL37 L (SEQ ID NO: 787) | AT3G24510 (SEQ ID NO: 797) | AT3G24510_P1 SEQ ID NO: 804 | 3000 |
| PrBDL37 S (SEQ ID NO: 788) | AT3G24510 (SEQ ID NO: 797) | AT3G24510_P1 SEQ ID NO: 804 | 1423 |
| PrBDL39 L (SEQ ID NO: 789) | AT3G61040 (SEQ ID NO: 798) | AT3G61040_P1 SEQ ID NO: 805 | 3000 |
| PrBDL39 S (SEQ ID NO: 790) | AT3G61040 (SEQ ID NO: 798) | AT3G61040_P1 SEQ ID NO: 805 | 1159 |

TABLE 17-continued

| Identification of novel promoters | | | |
|---|---|---|---|
| Promoter designation (SEQ ID NO:) | The polynucleotides (GenBank Accession Nos. and SEQ ID NO:) positioned downstream of the identified promoters | The polypeptides (GenBank Accession Nos. and SEQ ID NO:) encoded by the polynucleotides positioned downstream of the identified promoters | Promoter length (bp) |
| PrBDL35 L (SEQ ID NO: 791) | AT4G15975 (SEQ ID NO: 799) | AT4G15975_P1 SEQ ID NO: 806 | 2881 |
| PrBDL35 S (SEQ ID NO: 792) | AT4G15975 (SEQ ID NO: 799) | AT4G15975_P1 SEQ ID NO: 806 | 942 |

Table 17. Provided are the identified promoters, their length and sequence identifiers along with the genes found downstream to the promoters.

Construction of promoter::GUS fusion nucleic acid construct for analysis of expression pattern of the identified promoters—For cloning of each of the promoter sequences two sets of primers that span the predicted promoter sequence were designed. The short sequence of the promoter was amplified using a 3' primer sequence selected near the start codon of the coding sequence of the downstream gene (which is located downstream to the promoter sequences) and a 5' primer sequence selected from the sequence that is downstream to the adjacent upstream gene. The long sequence of the promoter was using a 3' primer sequence selected from the start of the untranslated region (5'UTR) of the gene downstream of the promoter and a 5' primer sequence located 3 kb upstream of the 3' primer (See Table 18, below). Each promoter sequences was translationally fused to the GUS coding sequence (a reporter gene).

All sequences were amplified by PCR. The PCR products were purified using MINELUTE® (QIAGEN GmbH) PCR purification kit (Qiagen) and sequencing of the amplified PCR products was performed, using ABI 377 sequencer (Applied Biosystems). To facilitate cloning of the promoter sequences, a 8-12 bp extension was added to the 5' of each primer. The primer extension includes an endonuclease restriction site. The restriction sites are selected using two parameters: a.) The site does not exist in the promoter sequence. b.) The restriction sites in the forward and reverse primers are designed so the digested genomic DNA is inserted in the sense formation into the binary vector utilized for transformation. For instance, the pGI plasmid vector was constructed by inserting a synthetic poly-(A) signal sequence, originating from pGL3 basic plasmid vector (Promega, Acc. No. U47295; by 4658-4811) into the HindIII restriction site of the binary vector pBI101.3 (Clontech, Acc. No. U12640) and GUS-Intron gene (Vancanneyt. G, et al MGG 220, 245-50, 1990). Another plasmid vector used for cloning was the pMBLArt (Gleave A P. Plant Mol Biol. 1992 December; 20(6): 1203-7).

The digested PCR products were first subcloned into pBlue-script KS [(originated from the pBlue-script KS plasmid vector stratagene (dot) com/manuals/212205 (dot) pdf)] followed by cloning into pGI binary vector with the GUS-Intron gene (Vancanneyt. G, et al MGG 220, 245-50, 1990) and the NOS terminator originated from pBI 101.3 binary vector (GenBank Accession No. U12640; GI:529333 nucleotides 4356 to 4693, SEQ ID NO:776). Some of the PCR products were first sublcloned pBlue-script KS [(originated from the pBlue-script KS plasmid vector stratagene (dot) com/manuals/212205 (dot) pdf)] with the GUS-Intron gene (Vancanneyt. G, et al MGG 220, 245-50, 1990) and the NOS terminator originated from pBI 101.3 binary vector followed by cloning the entire cassette into the binary vector pMBLArt (according to Table 19). The digested PCR product and the linearized plasmid vector were ligated using T4 DNA ligase enzyme (Roche, Switzerland). The primers used for cloning are provided in Table 18.

TABLE 18

| Primers used for the cloning of the novel promoters | | |
|---|---|---|
| Promoter Name | Restriction Enzymes used for cloning | Primers used for amplification/ SEQ ID NO: |
| PrBDL34_L | PstI, SalI | Fwd: PrBDL34_EF_PstI- ATCTGCAGGAAATTGGAAAAGGGTTTAAC/ SEQ ID NO: 995 Rev: PrBDL34_ER_SalI- ATTGTCGACGATTAGTTCTTGATTCTTGATCTTTC/ SEQ ID NO: 996 |
| PrBDL35 L | HindIII, SalI | Fwd: PrBDL_35_F_HindIII- ATAAAGCTTCATTGACTTGAGATTCAGTTCATG/ SEQ ID NO: 997 Rev: PrBDL_35_R_SalI- ATTGTCGACAGAGAAGTGAATGAAGATTTTAGG/ SEQ ID NO: 98 |
| PrBDL36 L | SalI, XbaI | Fwd: PrBDL_36_F_SalI- AATGTCGACCGAATCAATACGTAACTTTCAATC/ SEQ ID NO: 999 Rev: PrBDL_36_R_XbaI- |

TABLE 18-continued

| Primers used for the cloning of the novel promoters | | |
|---|---|---|
| Promoter Name | Restriction Enzymes used for cloning | Primers used for amplification/ SEQ ID NO: |
| | | TATCTAGATGCTTTGTTTTGTTTTGTTTTG/ SEQ ID NO: 1000 |
| PrBDL37_S | HindIII, SalI | Fwd: PrBDL37_Short_F_HindIII- ACTAAGCTTGACTTGATACTAACGAGGAAATG/ SEQ ID NO: 001 Rev: PrBDL37_Short_R_SalI- TGTGTCGACTTTCAAATTTTTAGAATGGGAG/ SEQ ID NO: 1002 |
| PrBDL38_S | PstI, SalI | Fwd: PrBDL38_Short_Fl_PstI- AACTGCAGAGCTCACGAGTGTGTTTTTGG/ SEQ ID NO: 1003 Rev: PrBDL38_Short_R_SalI- ATTGTCGACTGTATCTGATCATATCTTACCGG/ SEQ ID NO: 1004 |
| PrBDL39 L | HIndIII, SmaI | Fwd: PrBDL_39_F_HindIII- ATTAAGCTTCCTGCAACAATGATTTATTATG/ SEQ ID NO: 1005 Rev: PrBDL_39_R_SmaI- TCCCGGGCTAATATTATGCACGCTTCGTC/ SEQ ID NO: 1006 |
| PrBDL40 L | HindIII, SalI | Fwd: PrBDL_40_F_HindIII- TATAAGCTTCATCTCGGACTTGATATCGTC/ SEQ ID NO: 1007 Rev: PrBDL_40_R_SalI-1- ATTGTCGACGAATCGAACAAACGAACATAAA/ SEQ ID NO: 1008 |

Table 18.

Table 19, hereinbelow, provides the cloning vectors used to clone each of the identified promoters.

TABLE 19

| Promoters cloned into different binary vectors | | |
|---|---|---|
| Promoter | Cloned In pGI | Cloned In pMBLArt |
| PrBDL40 L | | V |
| PrBDL34 L | | V |
| PrBDL36 L | V | |
| PrBDL38 S | | V |
| PrBDL37 S | | V |
| PrBDL39 L | | V |
| PrBDL35 L | | V |

Table 19: Provided are the promoter designations (sequence identifiers are given in Table 17, above) and the vectors used for their cloning.
"V" indicates that the promoter was cloned in the noted vector.

Constructs were transformed into Arabidopsis plants as described in Example 5 above and expression analysis based on the monitoring the expression level of the GUS gene (GUS staining) was performed essentially as described in Jefferson R A. et. al. 1987 EMBO J 6 (13), 3901-3907; and Meissner et. al. 2000 Plant Journal 22 (3), 265-274.

The level of GUS staining was determined according to the intensity of the blue color. Table 20, below, provides the coloring level of GUS staining.

TABLE 20

| Coloring level | |
|---|---|
| no color | 0 |
| medium − | 2 |
| medium dark | 3 |
| medium + | 4 |
| darkest | 5 |

Table 20: The index of blue color intensity.

Table 21, hereinbelow, describes the expression pattern of the cloned promoters.

TABLE 21

| Expression pattern of developmental stage promoters | | | | | | | |
|---|---|---|---|---|---|---|---|
| Promoter | Promoter SEQ ID NO: | Event | Small flowers | Large flowers | Leaves | Stalk | Siliques |
| pMBL_GI | 777 | 5681.1 | 4-5 | 2 | 3 | 2-5 | 2-5 |
| pMBL_GI | 777 | 5681.2 | 4-5 | 2 | 2-3 | 2-5 | 3-5 |
| pMBL_GI | 777 | 5681.3 | 4-5 | 2 | 3 | 2-5 | 2-5 |
| pMBL_GI | 777 | 5681.4 | 4-5 | 2 | 3 | 3-5 | 3-5 |
| pMBL_GI | 777 | 5681.5 | 4-5 | 2 | 3 | 2-5 | 2-5 |

TABLE 21-continued

Expression pattern of developmental stage promoters

| Promoter | Promoter SEQ ID NO: | Event | Small flowers | Large flowers | Leaves | Stalk | Siliques |
|---|---|---|---|---|---|---|---|
| pM_PrBDL40_YN | 779 | 6552.1 | 0 | 0 | 1 | 1-3 | 1 |
| pM_PrBDL40_YN | 779 | 6552.2 | 0 | 0 | 1 | 0-2 | 0 |
| pM_PrBDL40_YN | 779 | 6552.3 | 3 | 3 | 3 | 3 | 3 |
| pM_PrBDL40_YN | 779 | 6552.4 | 0 | 5 | 1 | 5 | 0 |
| pM_PrBDL40_YN | 779 | 6554.1 | 0 | 0 | 0 | 0-1 | 0 |
| pM_PrBDL40_YN | 779 | 6554.2 | 1 | 4 | 0-5 | 3 | 0 |
| pM_PrBDL40_YN | 779 | 6554.3 | 0 | 4 | 0-5 | 5 | 0 |
| pM_PrBDL40_YN | 779 | 6554.4 | 0 | 1-2 | 0-2 | 0 | 0 |
| pM_PrBDL39_YN | 789 | 6501.1 | 0 | 0 | 0 | 0 | 0 |
| pM_PrBDL39_YN | 789 | 6501.2 | 1 | 0 | 0 | 0 | 0 |
| pM_PrBDL39_YN | 789 | 6501.3 | 0 | 0 | 0 | 0 | 0 |
| pM_PrBDL39_YN | 789 | 6501.4 | 0 | 0 | 0 | 0 | 0 |
| pM_PrBDL39_YN | 789 | 6501.5 | 0 | 0 | 0 | 0 | 0 |
| pM_PrBDL39_YN | 789 | 6502.1 | 0 | 0 | 0 | 0 | 0 |
| pM_PrBDL39_YN | 789 | 6502.2 | 0 | 0 | 0 | 0 | 0 |
| pM_PrBDL39_YN | 789 | 6502.3 | 0 | 0 | 0 | 0 | 0 |
| pM_PrBDL39_YN | 789 | 6502.4 | 0 | 0 | 0 | 0 | 0 |
| pM_PrBDL39_YN | 789 | 6502.5 | 0 | 0 | 0 | 0 | 0 |
| pM_PrBDL35_YN | 791 | 6512.1 | 0 | 0 | 0 | 0 | 0 |
| pM_PrBDL35_YN | 791 | 6512.2 | 0 | 0 | 0 | 0 | 0 |
| pM_PrBDL35_YN | 791 | 6512.3 | 0 | 0 | 0 | 0 | 3 |
| pM_PrBDL35_YN | 791 | 6512.4 | 0 | 0 | 0 | 0 | 0 |
| pM_PrBDL35_YN | 791 | 6512.5 | 0 | 0 | 0 | 0 | 0 |
| pM_PrBDL35_YN | 791 | 6511.1 | 0 | 0 | 0 | 0 | 0 |
| pM_PrBDL35_YN | 791 | 6511.2 | 0 | 0 | 0 | 0 | 3-5 |
| pM_PrBDL35_YN | 791 | 6511.3 | 0 | 0 | 0 | 0 | 1-2 |
| pM_PrBDL35_YN | 791 | 6511.4 | 0 | 0 | 0 | 0 | 0 |
| pM_PrBDL35_YN | 791 | 6511.5 | 0 | 0 | 0 | 0 | 0 |
| WT | | | 0 | 0 | 0 | 0 | 0 |

Table 21. "pM" or "pMBL" refer to the binary vector pMBLArt which includes the CaMV35S promoter (SEQ ID NO: 777).
"Y" or "GI" refer to GUS intron.
"N" refers to NOS terminator.
pMBL_GI serves as a positive control.
PrBDL40 = SEQ ID NO: 779 (L);
PrBDL39 = SEQ ID NO: 789 (L));
PrBDL35 = SEQ ID NO: 791 (L)

These results demonstrate that the novel promoters of the invention are capable of directing expression of a heterologous polynucleotide in a host cell in a tissue specific and/or developmental stage-specific manner.

Example 7

Improved Transgenic Plant Performance

To analyze the effect of expression of the isolated polynucleotides in plants, plants were grown in pots with an adequate amount of nutrients and water. The plants were analyzed for their overall size, growth rate, time to inflorescence emergence (bolting) and flowering, seed yield, weight of 1,000 seeds, dry matter and harvest index [(HI) seed yield/dry matter]. Transgenic plants performance was compared to control plants grown in parallel under the same conditions. Mock-transgenic plants with an empty vector or expressing the uidA reporter gene (GUS-Intron) under the same promoter were used as control.

Parameters were measured as described in Example 3 above.

Statistical analyses—Plant growth rate, plant area, time to bolt, time to flower, weight of 1,000 seeds, seed yield, oil yield, dry matter, and harvest index area data were analyzed using t-test. To identify outperforming genes and constructs, results from mix of transformation events or independent events were analyzed. For gene versus control analysis t-test was applied, using significance of $p<0.1$. The JMP statistics software package was used (Version 5.2.1, SAS Institute Inc., Cary, N.C., USA).

Experimental Results

Plants expressing the polynucleotides of the invention were assayed for a number of commercially desired traits. Table 22 provides the parameters measured in a tissue culture assay (results are presented in Table 23).

TABLE 22

| Parameter symbol used in result Table 23 | Parameter name |
|---|---|
| 1 | Leaf Area time point 1 |
| 2 | Leaf Area time point 2 |
| 3 | Leaf Area time point 3 |
| 4 | Roots Length time point 1 |
| 5 | Roots Length time point 2 |
| 6 | Roots Length time point 3 |
| 7 | Roots Coverage time point 1 |
| 8 | Roots Coverage time point 2 |
| 9 | Roots Coverage time point 3 |
| 10 | RGR of Leaf Area time point 2 |
| 11 | RGR of Leaf Area time point 3 |
| 12 | RGR of Roots Coverage time point 2 |
| 13 | RGR of Roots Coverage time point 3 |
| 14 | RGR of Roots Length time point 2 |
| 15 | RGR of Roots Length time point 3 |

TABLE 22-continued

| Parameter symbol used in result Table 23 | Parameter name |
|---|---|
| 16 | Fresh Weight |
| 17 | Dry Weight |

Table 22.
RGR = relative growth rate.

Analysis of plants in tissue culture assay—Table 23, hereinbelow, depicts analyses of seed yield in plants overexpressing the polynucleotides of the invention under the regulation of the constitutive 35S (SEQ ID NO:777) or At6669 (SEQ ID NO:775) promoters. In cases where a certain event appears more than once, the event was tested in several independent experiments.

TABLE 23

Results obtained in a tissue culture assay

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL100 | 7872.2 | P | | | | | | | | | | | 0.10 | | 0.07 | 0.34 | 0.17 | | |
| BDL100 | 7872.2 | Av | | | | | | | | | | | 1.15 | | 1.77 | 1.24 | 1.40 | | |
| BDL100 | 7872.3 | P | | | | | | | | | | | 0.22 | | 0.19 | | 0.01 | | |
| BDL100 | 7872.3 | Av | | | | | | | | | | | 1.10 | | 1.46 | | 1.63 | | |
| BDL100 | 7873.2 | P | | | | | | | | | | | 0.16 | 0.75 | 0.02 | 0.51 | 0.01 | | |
| BDL100 | 7873.2 | Av | | | | | | | | | | | 1.12 | 1.13 | 1.94 | 1.17 | 1.75 | | |
| BDL100 | 7873.3 | P | | | | | | | | | | | 0.24 | | 0.09 | | 0.01 | | |
| BDL100 | 7873.3 | Av | | | | | | | | | | | 1.16 | | 1.47 | | 1.76 | | |
| BDL100 | 7873.4 | P | | | | | | | | 0.20 | 0.06 | 0.16 | | | 0.01 | | 0.06 | | |
| BDL100 | 7873.4 | Av | | | | | | | | 1.12 | 1.25 | 1.22 | | | 1.17 | | 1.12 | | |
| BDL108 | 8122.1 | P | | | | | | | | | | 0.20 | 0.24 | | 0.50 | | 0.11 | | |
| BDL108 | 8122.1 | Av | | | | | | | | | | 1.38 | 1.35 | | 1.32 | | 1.58 | | |
| BDL108 | 8122.2 | P | | | | | | | | | | 0.09 | | 0.09 | | 0.12 | | | |
| BDL108 | 8122.2 | Av | | | | | | | | | | 1.83 | | 1.47 | | 1.27 | | | |
| BDL108 | 8123.5 | P | | | | | | | | | | | | | 0.77 | | 0.32 | | |
| BDL108 | 8123.5 | Av | | | | | | | | | | | | | 1.13 | | 1.31 | | |
| BDL108 | 8123.6 | P | | | | | | | | | | | | | | | | | |
| BDL108 | 8123.6 | Av | | | | | | | | | | | | | | | | | |
| BDL110 | 8092.1 | P | | | 0.05 | | | | 0.41 | | | | 0.13 | | 0.42 | | 0.31 | | 0.31 |
| BDL110 | 8092.1 | Av | | | 1.23 | | | | 1.13 | | | | 1.39 | | 1.16 | | 1.15 | | 1.33 |
| BDL110 | 8092.2 | P | | | | | | | | | | | 0.35 | 0.22 | 0.13 | 0.18 | 0.04 | | |
| BDL110 | 8092.2 | Av | | | | | | | | | | | 1.22 | 3.01 | 1.25 | 2.69 | 1.33 | | |
| BDL110 | 8092.5 | P | 0.00 | 0.01 | 0.00 | | | | | | | | 0.01 | 0.18 | 0.16 | 0.11 | 0.33 | | 0.01 |
| BDL110 | 8092.5 | Av | 1.86 | 1.30 | 1.53 | | | | | | | | 1.40 | 2.04 | 1.58 | 2.58 | 1.11 | | 2.24 |
| BDL110 | 8095.2 | P | 0.00 | | | | | | | | | | 0.05 | 0.22 | 0.00 | | 0.03 | | 0.10 |
| BDL110 | 8095.2 | Av | 1.53 | | | | | | | | | | 1.47 | 1.23 | 1.62 | | 1.40 | | 1.56 |
| BDL110 | 8722.3 | P | | | | | | | | | | | 0.07 | 0.01 | 0.22 | 0.05 | 0.06 | | 0.16 |
| BDL110 | 8722.3 | Av | | | | | | | | | | | 1.36 | 2.31 | 1.14 | 2.47 | 1.28 | | 1.47 |
| BDL114 | 7741.3 | P | | | | | | | | | | 0.07 | 0.66 | 0.01 | 0.01 | 0.02 | 0.15 | | |
| BDL114 | 7741.3 | Av | | | | | | | | | | 1.51 | 1.17 | 1.84 | 1.51 | 1.75 | 1.37 | | |
| BDL114 | 7741.6 | P | | | | 0.24 | 0.34 | | 0.64 | | | 0.00 | 0.25 | | | | | | |
| BDL114 | 7741.6 | Av | | | | 1.14 | 1.22 | | 1.13 | | | 1.40 | 1.23 | | | | | | |
| BDL114 | 7742.1 | P | | | | 0.36 | | 0.26 | 0.19 | 0.62 | 0.14 | 0.06 | | | | | 0.51 | | |
| BDL114 | 7742.1 | Av | | | | 1.12 | | 1.15 | 1.32 | 1.14 | 1.29 | 1.49 | | | | | 1.16 | | |
| BDL114 | 7742.3 | P | | | | | | | | | | 0.17 | 0.69 | 0.08 | 0.09 | 0.08 | 0.01 | | |
| BDL114 | 7742.3 | Av | | | | | | | | | | 1.28 | 1.24 | 2.68 | 2.00 | 2.89 | 1.80 | | |
| BDL114 | 7742.5 | P | | | | | | | | | | 0.24 | 0.37 | 0.31 | 0.06 | 0.59 | 0.06 | | |
| BDL114 | 7742.5 | Av | | | | | | | | | | 1.22 | 1.40 | 1.47 | 2.31 | 1.27 | 2.05 | | |
| BDL116 | 7481.2 | P | | | | | | | | | | 0.32 | | 0.06 | | 0.16 | 0.04 | | |
| BDL116 | 7481.2 | Av | | | | | | | | | | 1.34 | | 1.59 | | 1.27 | 1.14 | | |
| BDL116 | 7481.7 | P | | | | | | | | | | | | 0.03 | 0.21 | 0.01 | 0.07 | | |
| BDL116 | 7481.7 | Av | | | | | | | | | | | | 1.85 | 1.44 | 2.11 | 1.59 | | |
| BDL116 | 7481.8 | P | | | | 0.30 | 0.13 | 0.24 | 0.59 | 0.30 | 0.42 | 0.27 | 0.36 | 0.62 | | 0.17 | | | |
| BDL116 | 7481.8 | Av | | | | 1.25 | 1.40 | 1.26 | 1.15 | 1.34 | 1.26 | 1.16 | 1.17 | 1.12 | | 1.20 | | | |
| BDL116 | 7482.2 | P | | | | | | | | | | 0.46 | 0.62 | 0.22 | 0.35 | 0.02 | 0.17 | | |
| BDL116 | 7482.2 | Av | | | | | | | | | | 1.11 | 1.16 | 1.40 | 1.56 | 1.44 | 1.58 | | |
| BDL116 | 7485.1 | P | | | | | | | | | | 0.21 | | 0.26 | 0.20 | 0.03 | 0.10 | | |
| BDL116 | 7485.1 | Av | | | | | | | | | | 1.27 | | 1.78 | 1.47 | 2.06 | 1.44 | | |
| BDL120 | 7891.3 | P | | | | | | | | | | | | 0.12 | 0.07 | 0.01 | 0.01 | | |
| BDL120 | 7891.3 | Av | | | | | | | | | | | | 1.35 | 1.41 | 1.63 | 1.52 | | |
| BDL120 | 7892.4 | P | | | | | | | | | | 0.28 | 0.42 | 0.04 | 0.15 | 0.02 | 0.03 | | |
| BDL120 | 7892.4 | Av | | | | | | | | | | 1.15 | 1.12 | 2.33 | 1.44 | 2.49 | 1.70 | | |
| BDL120 | 7892.6 | P | | | | | | | | | | | | | 0.03 | 0.77 | 0.02 | | |
| BDL120 | 7892.6 | Av | | | | | | | | | | | | | 1.63 | 1.12 | 1.44 | | |
| BDL120 | 7893.2 | P | | | | | | | | | | | 0.36 | | 0.17 | 0.57 | 0.06 | | 0.28 |
| BDL120 | 7893.2 | Av | | | | | | | | | | | 1.27 | | 1.96 | 1.14 | 1.86 | | 1.26 |
| BDL120 | 7893.5 | P | | | | | | | | | | | | | 0.30 | | 0.45 | | |
| BDL120 | 7893.5 | Av | | | | | | | | | | | | | 1.73 | | 1.49 | | |
| BDL123 | 8082.1 | P | | | | | | | | | | | 0.05 | 0.54 | 0.07 | 0.17 | 0.11 | | |
| BDL123 | 8082.1 | Av | | | | | | | | | | | 1.37 | 1.19 | 1.38 | 1.58 | 1.59 | | |
| BDL123 | 8082.3 | P | | | | | | | | | | | | 0.27 | 0.12 | 0.33 | 0.01 | | 0.43 |
| BDL123 | 8082.3 | Av | | | | | | | | | | | | 1.64 | 1.75 | 1.41 | 1.85 | | 1.18 |
| BDL123 | 8082.6 | P | | | | | | | | | | | | 0.03 | 0.07 | 0.07 | 0.01 | | |

TABLE 23-continued

Results obtained in a tissue culture assay

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL123 | 8082.6 | Av | | | | | | | | | | | | 1.67 | 1.52 | 2.05 | 1.62 | | |
| BDL123 | 8083.2 | P | | | | | | | | | | | 0.07 | 0.35 | 0.45 | 0.31 | 0.07 | | |
| BDL123 | 8083.2 | Av | | | | | | | | | | | 1.25 | 1.62 | 1.50 | 1.67 | 1.86 | | |
| BDL123 | 8083.3 | P | | | | | | | | | | 0.20 | | 0.72 | 0.11 | 0.34 | 0.18 | | |
| BDL123 | 8083.3 | Av | | | | | | | | | | 1.34 | | 1.12 | 1.57 | 1.28 | 1.51 | | |
| BDL125 | 7491.1 | P | | | | | | | | | | 0.30 | | | 0.36 | | 0.26 | | |
| BDL125 | 7491.1 | Av | | | | | | | | | | 1.16 | | | 1.46 | | 1.38 | | |
| BDL125 | 7491.5 | P | | | | | | | | | | | 0.16 | | 0.03 | 0.43 | 0.01 | | |
| BDL125 | 7491.5 | Av | | | | | | | | | | | 1.24 | | 2.32 | 1.28 | 2.15 | | |
| BDL125 | 7492.5 | P | | | | | | | | | | 0.29 | | 0.03 | 0.22 | 0.00 | 0.04 | | |
| BDL125 | 7492.5 | Av | | | | | | | | | | 1.22 | | 2.17 | 1.54 | 2.83 | 1.61 | | |
| BDL125 | 7494.1 | P | | | | | 0.04 | 0.07 | | 0.05 | 0.14 | | | 0.30 | | 0.08 | | | 0.23 |
| BDL125 | 7494.1 | Av | | | | | 1.21 | 1.20 | | 1.41 | 1.43 | | | 1.81 | | 2.60 | | | 1.45 |
| BDL125 | 7495.5 | P | | | | | | | | | | 0.36 | 0.51 | 0.05 | 0.09 | 0.05 | 0.00 | | |
| BDL125 | 7495.5 | Av | | | | | | | | | | 1.12 | 1.10 | 3.54 | 1.45 | 3.05 | 1.82 | | |
| BDL128 | 7711.3 | P | | | | | | | | | | | | | | | 0.37 | | |
| BDL128 | 7711.3 | Av | | | | | | | | | | | | | | | 1.35 | | |
| BDL128 | 8361.5 | P | | | | | | | | | | | | 0.13 | 0.08 | 0.10 | 0.09 | | |
| BDL128 | 8361.5 | Av | | | | | | | | | | | | 1.74 | 1.43 | 1.91 | 1.66 | | |
| BDL128 | 8362.2 | P | | | | | | | | | | | 0.32 | | 0.18 | | 0.35 | | |
| BDL128 | 8362.2 | Av | | | | | | | | | | | 1.17 | | 1.31 | | 1.36 | | |
| BDL128 | 8363.2 | P | | | | | | | | | | | 0.04 | 0.30 | 0.05 | 0.15 | 0.00 | | |
| BDL128 | 8363.2 | Av | | | | | | | | | | | 1.24 | 1.37 | 1.46 | 1.83 | 1.46 | | |
| BDL128 | 8365.2 | P | | | | | | | | | | | 0.02 | | 0.01 | | 0.11 | | |
| BDL128 | 8365.2 | Av | | | | | | | | | | | 1.70 | | 3.04 | | 2.64 | | |
| BDL129 | 7691.2 | P | 0.13 | 0.40 | 0.35 | | | | | | 0.54 | | 0.63 | 0.00 | 0.18 | 0.03 | 0.52 | 0.00 | 0.09 |
| BDL129 | 7691.2 | Av | 1.40 | 1.30 | 1.34 | | | | | | 1.27 | | 1.14 | 2.99 | 1.77 | 2.10 | 1.17 | 1.83 | 1.73 |
| BDL129 | 7692.2 | P | | | 0.10 | | | | | | | | 0.16 | 0.01 | 0.00 | 0.03 | 0.00 | 0.03 | 0.09 |
| BDL129 | 7692.2 | Av | | | 1.16 | | | | | | | | 1.29 | 3.43 | 1.85 | 1.82 | 1.71 | 1.85 | 1.42 |
| BDL129 | 7692.5 | P | | | | | | | | | | 0.03 | | | 0.09 | | 0.08 | | |
| BDL129 | 7692.5 | Av | | | | | | | | | | 1.37 | | | 1.71 | | 1.61 | | |
| BDL129 | 7693.1 | P | | | | | | | | | | 0.51 | | 0.00 | 0.27 | 0.00 | 0.27 | | |
| BDL129 | 7693.1 | Av | | | | | | | | | | 1.37 | | 2.05 | 1.58 | 1.82 | 1.52 | | |
| BDL129 | 7693.4 | P | | | | | | | | | | | | 0.07 | 0.09 | 0.05 | 0.13 | | |
| BDL129 | 7693.4 | Av | | | | | | | | | | | | 2.43 | 1.83 | 1.69 | 1.60 | | |
| BDL130 | 7661.7 | P | 0.06 | 0.01 | 0.00 | | | | | | | | 0.00 | 0.02 | 0.12 | 0.04 | 0.01 | 0.01 | 0.27 |
| BDL130 | 7661.7 | Av | 1.22 | 1.14 | 1.32 | | | | | | | | 1.45 | 3.08 | 1.79 | 2.15 | 1.58 | 1.88 | 1.23 |
| BDL130 | 7663.1 | P | | 0.03 | 0.25 | | | | | | | 0.00 | | | 0.00 | | 0.00 | | 0.67 |
| BDL130 | 7663.1 | Av | | 1.24 | 1.20 | | | | | | | 1.40 | | | 1.41 | | 1.53 | | 1.10 |
| BDL130 | 7663.3 | P | | | | | | | | | | | 0.06 | 0.42 | 0.01 | 0.62 | 0.01 | | |
| BDL130 | 7663.3 | Av | | | | | | | | | | | 1.60 | 1.29 | 2.93 | 1.14 | 1.96 | | |
| BDL130 | 7663.6 | P | | | | | | | | | | | 0.12 | 0.03 | 0.08 | 0.04 | 0.00 | | |
| BDL130 | 7663.6 | Av | | | | | | | | | | | 1.21 | 2.28 | 1.75 | 1.98 | 1.79 | | |
| BDL130 | 7664.5 | P | 0.33 | 0.03 | 0.00 | | | 0.10 | 0.07 | 0.26 | 0.00 | 0.02 | | | 0.00 | | 0.00 | 0.51 | |
| BDL130 | 7664.5 | Av | 1.11 | 1.35 | 1.35 | | | 1.16 | 1.19 | 1.11 | 1.31 | 1.33 | | | 1.37 | | 1.42 | 1.10 | |
| BDL130 | 8572.4 | P | 0.01 | 0.07 | 0.07 | | | | | | | | 0.23 | 0.05 | 0.00 | 0.10 | 0.00 | 0.00 | 0.01 |
| BDL130 | 8572.4 | Av | 1.47 | 1.18 | 1.29 | | | | | | | | 1.20 | 2.51 | 2.92 | 1.72 | 2.16 | 2.33 | 2.68 |
| BDL130 | 8573.5 | P | | 0.35 | 0.08 | | | 0.32 | | | 0.15 | | 0.29 | 0.28 | 0.09 | | 0.09 | 0.04 | 0.18 |
| BDL130 | 8573.5 | Av | | 1.12 | 1.21 | | | 1.13 | | | 1.28 | | 1.22 | 1.30 | 1.91 | | 1.33 | 1.36 | 1.24 |
| BDL130 | 8574.2 | P | | | | | | | | | 0.39 | 0.46 | 0.23 | 0.28 | 0.05 | | 0.06 | 0.16 | 0.10 |
| BDL130 | 8574.2 | Av | | | | | | | | | 1.17 | 1.15 | 1.28 | 1.44 | 1.84 | | 1.64 | 1.37 | 1.60 |
| BDL130 | 8574.4 | P | 0.03 | 0.05 | 0.01 | 0.37 | 0.13 | 0.05 | 0.17 | 0.03 | 0.02 | | 0.14 | 0.61 | 0.55 | | | 0.05 | 0.05 |
| BDL130 | 8574.4 | Av | 1.46 | 1.50 | 1.65 | 1.40 | 1.35 | 1.32 | 1.98 | 2.00 | 2.05 | | 1.25 | 1.12 | 1.14 | | | 2.26 | 2.30 |
| BDL130 | 8575.1 | P | 0.00 | 0.00 | 0.00 | | 0.11 | 0.08 | 0.00 | 0.03 | 0.02 | | | 0.13 | | 0.03 | 0.13 | 0.00 | 0.31 |
| BDL130 | 8575.1 | Av | 1.44 | 1.51 | 1.56 | | 1.21 | 1.28 | 1.50 | 1.94 | 1.88 | | | 1.32 | | 1.35 | 1.20 | 2.07 | 1.59 |
| BDL131 | 8631.1 | P | 0.02 | | | | | | | | | | | 0.40 | 0.06 | | | 0.05 | 0.00 |
| BDL131 | 8631.1 | Av | 1.36 | | | | | | | | | | | 1.23 | 1.77 | | | 1.82 | 1.65 |
| BDL131 | 8632.2 | P | 0.01 | 0.01 | 0.01 | | 0.24 | 0.15 | | 0.25 | 0.03 | | | 0.03 | 0.20 | 0.00 | | 0.03 | 0.05 |
| BDL131 | 8632.2 | Av | 1.61 | 1.64 | 1.66 | | 1.20 | 1.19 | | 1.30 | 1.60 | | | 2.05 | 1.58 | 1.65 | | 3.33 | 2.82 |
| BDL131 | 8633.2 | P | 0.14 | | | | | | | | | | 0.39 | 0.48 | 0.05 | | 0.14 | 0.11 | 0.08 |
| BDL131 | 8633.2 | Av | 1.12 | | | | | | | | | | 1.21 | 1.22 | 2.07 | | 1.20 | 1.38 | 1.74 |
| BDL131 | 8634.2 | P | 0.00 | 0.13 | 0.08 | | | | | | 0.13 | | 0.22 | 0.03 | 0.00 | 0.00 | 0.01 | 0.00 | 0.00 |
| BDL131 | 8634.2 | Av | 1.34 | 1.23 | 1.35 | | | | | | 1.27 | | 1.23 | 2.70 | 2.39 | 2.04 | 1.54 | 2.04 | 2.49 |
| BDL131 | 8635.4 | P | 0.00 | 0.15 | 0.23 | 0.08 | 0.12 | 0.18 | 0.12 | 0.09 | 0.11 | 0.49 | 0.30 | 0.27 | | 0.51 | | 0.05 | 0.03 |
| BDL131 | 8635.4 | Av | 1.24 | 1.41 | 1.70 | 1.14 | 1.26 | 1.28 | 1.35 | 1.77 | 1.79 | 1.20 | 1.34 | 1.41 | | 1.17 | | 1.68 | 2.07 |
| BDL133 | 8542.2 | P | | | | | | | | | | | | 0.45 | | | | 0.47 | 0.52 |
| BDL133 | 8542.2 | Av | | | | | | | | | | | | 1.10 | | | | 1.11 | 1.20 |
| BDL133 | 8542.3 | P | | 0.04 | 0.02 | | 0.02 | 0.00 | | 0.02 | 0.01 | 0.05 | 0.21 | 0.01 | 0.16 | 0.01 | 0.03 | 0.10 | 0.00 |
| BDL133 | 8542.3 | Av | | 1.41 | 1.72 | | 1.30 | 1.47 | | 1.84 | 2.02 | 1.48 | 1.53 | 1.95 | 1.24 | 1.45 | 1.42 | 1.69 | 1.85 |
| BDL133 | 8543.4 | P | 0.16 | 0.10 | 0.17 | | | | | | 0.59 | 0.17 | | 0.17 | 0.01 | 0.41 | 0.00 | 0.09 | 0.15 |
| BDL133 | 8543.4 | Av | 1.21 | 1.36 | 1.43 | | | | | | 1.18 | 1.18 | | 1.39 | 1.91 | 1.25 | 1.58 | 2.03 | 1.73 |
| BDL133 | 8544.3 | P | 0.22 | 0.26 | 0.17 | | 0.14 | 0.04 | 0.51 | 0.23 | 0.07 | | 0.30 | 0.26 | 0.31 | 0.35 | 0.29 | 0.38 | 0.17 |
| BDL133 | 8544.3 | Av | 1.32 | 1.23 | 1.30 | | 1.16 | 1.20 | 1.24 | 1.39 | 1.51 | | 1.15 | 1.21 | 1.28 | 1.18 | 1.17 | 1.21 | 1.46 |
| BDL133 | 8545.3 | P | 0.07 | 0.01 | 0.00 | | 0.51 | 0.24 | | 0.18 | 0.07 | 0.51 | | 0.05 | 0.04 | 0.04 | 0.17 | 0.00 | 0.00 |
| BDL133 | 8545.3 | Av | 1.51 | 1.68 | 1.63 | | 1.10 | 1.18 | | 1.44 | 1.81 | 1.32 | | 2.76 | 1.55 | 2.12 | 1.26 | 2.51 | 3.55 |
| BDL134 | 7671.2 | P | | | | | | | | | | 0.69 | | | 0.61 | 0.21 | 0.07 | | |

TABLE 23-continued

Results obtained in a tissue culture assay

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL134 | 7671.2 | Av | | | | | | | | | | 1.12 | | | 1.17 | 1.30 | 1.42 | | |
| BDL134 | 7672.5 | P | | | | | | | | | | 0.33 | 0.63 | 0.24 | 0.08 | 0.20 | 0.04 | | |
| BDL134 | 7672.5 | Av | | | | | | | | | | 1.16 | 1.11 | 1.27 | 1.47 | 1.56 | 1.74 | | |
| BDL134 | 7673.1 | P | | | | | | | | | | 0.40 | | 0.12 | | 0.00 | 0.43 | | |
| BDL134 | 7673.1 | Av | | | | | | | | | | 1.13 | | 1.29 | | 1.74 | 1.24 | | |
| BDL134 | 7673.2 | P | | | | | | | | | | | 0.44 | | 0.00 | | 0.03 | | |
| BDL134 | 7673.2 | Av | | | | | | | | | | | 1.33 | | 2.67 | | 2.32 | | |
| BDL135 | 7723.9 | P | | | | 0.02 | 0.22 | | 0.04 | | | 0.00 | 0.08 | | | | | | |
| BDL135 | 7723.9 | Av | | | | 1.87 | 1.23 | | 2.11 | | | 1.62 | 1.19 | | | | | | |
| BDL135 | 8782.2 | P | | | | | | | | | | 0.33 | 0.39 | 0.44 | 0.10 | 0.00 | 0.29 | | |
| BDL135 | 8782.2 | Av | | | | | | | | | | 1.30 | 1.81 | 1.43 | 1.73 | 1.75 | 1.20 | | |
| BDL135 | 8783.1 | P | | | | 0.00 | 0.00 | 0.00 | 0.00 | 0.00 | 0.09 | 0.00 | 0.23 | | | | | | |
| BDL135 | 8783.1 | Av | | | | 2.70 | 2.40 | 1.85 | 3.94 | 2.48 | 1.80 | 1.68 | 1.20 | | | | | | |
| BDL135 | 8783.2 | P | | | | | | | | | | 0.32 | 0.48 | | | | | | |
| BDL135 | 8783.2 | Av | | | | | | | | | | 1.74 | 1.18 | | | | | | |
| BDL135 | 8785.5 | P | 0.02 | 0.07 | 0.14 | 0.10 | 0.01 | 0.02 | 0.03 | 0.03 | 0.05 | 0.20 | | | | 0.32 | | | |
| BDL135 | 8785.5 | Av | 1.16 | 1.28 | 1.33 | 1.67 | 1.96 | 1.76 | 1.66 | 2.53 | 2.26 | 1.17 | | | | 1.20 | | | |
| BDL137 | 7701.2 | P | | | | | | | | | | | 0.25 | 0.07 | 0.22 | 0.09 | 0.10 | | |
| BDL137 | 7701.2 | Av | | | | | | | | | | | 1.14 | 1.48 | 1.61 | 1.91 | 1.68 | | |
| BDL137 | 7701.5 | P | | | | | | | | | | | | 0.33 | 0.02 | 0.21 | 0.03 | | |
| BDL137 | 7701.5 | Av | | | | | | | | | | | | 2.23 | 1.36 | 1.92 | 1.44 | | |
| BDL137 | 7702.1 | P | | | | | | | | | | 0.30 | 0.32 | 0.27 | 0.05 | 0.40 | 0.08 | | |
| BDL137 | 7702.1 | Av | | | | | | | | | | 1.21 | 1.44 | 1.49 | 1.96 | 1.41 | 1.87 | | |
| BDL137 | 7703.3 | P | | 0.10 | 0.16 | | | 0.12 | | | 0.51 | 0.31 | | 0.03 | 0.13 | 0.03 | 0.08 | | |
| BDL137 | 7703.3 | Av | | 1.13 | 1.15 | | | 1.15 | | | 1.12 | 1.20 | | 1.95 | 1.17 | 2.59 | 1.26 | | |
| BDL137 | 7703.7 | P | | | | | | | | | | | 0.38 | 0.19 | 0.34 | 0.15 | 0.05 | | |
| BDL137 | 7703.7 | Av | | | | | | | | | | | 1.24 | 2.04 | 2.78 | 2.12 | 1.86 | | |
| BDL139 | 8581.5 | P | | | 0.38 | | | | | | | 0.23 | 0.30 | 0.10 | 0.01 | 0.15 | 0.09 | 0.05 | 0.02 |
| BDL139 | 8581.5 | Av | | | 1.14 | | | | | | | 1.16 | 1.20 | 1.58 | 1.54 | 1.35 | 1.37 | 1.57 | 1.68 |
| BDL139 | 8581.5 | P | | | | | | | | | | | | | | | | | 0.57 |
| BDL139 | 8581.5 | Av | | | | | | | | | | | | | | | | | 1.21 |
| BDL139 | 8581.6 | P | 0.01 | 0.01 | 0.07 | | 0.28 | | | 0.19 | 0.56 | 0.36 | | 0.12 | | 0.31 | | 0.00 | 0.00 |
| BDL139 | 8581.6 | Av | 1.90 | 2.16 | 1.46 | | 1.10 | | | 1.45 | 1.17 | 1.22 | | 2.54 | | 1.35 | | 2.79 | 4.10 |
| BDL139 | 8581.6 | P | | 0.32 | 0.43 | | | | | | | | | | | | | 0.10 | 0.01 |
| BDL139 | 8581.6 | Av | | 1.11 | 1.14 | | | | | | | | | | | | | 1.64 | 1.85 |
| BDL139 | 8583.1 | P | | | 0.24 | | | | | | | 0.09 | 0.12 | 0.00 | 0.00 | 0.03 | 0.00 | | 0.22 |
| BDL139 | 8583.1 | Av | | | 1.13 | | | | | | | 1.18 | 1.27 | 2.25 | 2.43 | 1.50 | 2.22 | | 1.36 |
| BDL139 | 8583.1 | P | | | | | | | | | | | | 0.20 | 0.59 | 0.36 | 0.27 | | |
| BDL139 | 8583.1 | Av | | | | | | | | | | | | 1.24 | 1.12 | 1.10 | 1.26 | | |
| BDL139 | 8584.1 | P | | | 0.31 | | | | | | | 0.59 | 0.23 | 0.06 | 0.00 | 0.09 | 0.01 | | 0.00 |
| BDL139 | 8584.1 | Av | | | 1.18 | | | | | | | 1.12 | 1.30 | 1.87 | 1.59 | 1.37 | 1.70 | | 1.77 |
| BDL139 | 8584.1 | P | | | | | | | | | | | 0.46 | 0.04 | 0.02 | 0.00 | 0.14 | | |
| BDL139 | 8584.1 | Av | | | | | | | | | | | 1.35 | 1.66 | 1.57 | 1.58 | 1.32 | | |
| BDL139 | 8585.2 | P | 0.00 | 0.01 | 0.02 | | | | | | 0.35 | | | 0.05 | 0.05 | 0.03 | 0.05 | | 0.11 |
| BDL139 | 8585.2 | Av | 1.61 | 1.52 | 1.49 | | | | | | 1.27 | | | 3.34 | 2.30 | 2.18 | 1.60 | | 2.38 |
| BDL139 | 8585.2 | P | 0.32 | | 0.23 | | | | | | | | 0.16 | | 0.13 | | 0.17 | 0.20 | 0.03 |
| BDL139 | 8585.2 | Av | 1.14 | | 1.22 | | | | | | | | 1.42 | | 1.33 | | 1.29 | 2.06 | 1.83 |
| BDL141 | 8641.3 | P | 0.02 | 0.06 | 0.01 | | 0.09 | 0.10 | | 0.16 | 0.11 | | | 0.00 | | 0.00 | | | 0.01 |
| BDL141 | 8641.3 | Av | 1.82 | 1.82 | 1.78 | | 1.51 | 1.42 | | 2.17 | 1.93 | | | 2.54 | | 1.95 | | | 3.77 |
| BDL141 | 8641.3 | P | | 0.49 | 0.10 | | | | | | | 0.45 | 0.10 | 0.49 | 0.52 | | | 0.10 | 0.10 |
| BDL141 | 8641.3 | Av | | 1.10 | 1.43 | | | | | | | 1.10 | 1.69 | 1.13 | 1.12 | | | 1.51 | 1.83 |
| BDL141 | 8641.4 | P | | | | | | | | | | | 0.50 | 0.01 | 0.14 | 0.02 | 0.11 | | 0.17 |
| BDL141 | 8641.4 | Av | | | | | | | | | | | 1.11 | 2.36 | 3.23 | 1.98 | 1.74 | | 1.90 |
| BDL141 | 8641.4 | P | | | 0.10 | | | | | | | | 0.12 | 0.21 | 0.05 | 0.42 | 0.10 | 0.08 | 0.05 |
| BDL141 | 8641.4 | Av | | | 1.18 | | | | | | | | 1.66 | 1.35 | 1.98 | 1.13 | 1.19 | 1.27 | 1.64 |
| BDL141 | 8642.3 | P | 0.01 | 0.05 | 0.01 | | | | | | 0.13 | | 0.18 | 0.01 | 0.03 | 0.03 | 0.02 | | 0.00 |
| BDL141 | 8642.3 | Av | 1.49 | 1.32 | 1.45 | | | | | | 1.33 | | 1.23 | 1.98 | 1.68 | 1.43 | 1.35 | | 2.64 |
| BDL141 | 8642.3 | P | | | | | | | | | | | 0.46 | | | | | | 0.02 |
| BDL141 | 8642.3 | Av | | | | | | | | | | | 1.26 | | | | | | 1.66 |
| BDL141 | 8642.6 | P | | | | | | | | | | | 0.24 | 0.15 | 0.22 | 0.24 | 0.15 | | 0.08 |
| BDL141 | 8642.6 | Av | | | | | | | | | | | 1.25 | 1.45 | 1.24 | 1.20 | 1.19 | | 1.83 |
| BDL141 | 8642.6 | P | | | | | | | | | | | | | | | | | 0.31 |
| BDL141 | 8642.6 | Av | | | | | | | | | | | | | | | | | 1.30 |
| BDL141 | 8643.3 | P | 0.00 | 0.07 | 0.08 | | | | | 0.63 | 0.22 | | | 0.06 | 0.11 | 0.01 | 0.19 | | 0.00 |
| BDL141 | 8643.3 | Av | 1.49 | 1.31 | 1.33 | | | | | 1.15 | 1.51 | | | 1.47 | 1.68 | 1.49 | 1.27 | | 3.80 |
| BDL141 | 8643.3 | P | | | | | | | | | | | 0.24 | | | | | 0.43 | 0.14 |
| BDL141 | 8643.3 | Av | | | | | | | | | | | 1.38 | | | | | 1.21 | 1.38 |
| BDL142 | 8283.2 | P | | | | | | | | | | | | | | | | | |
| BDL142 | 8283.2 | Av | | | | | | | | | | | | | | | | | |
| BDL142 | 8284.1 | P | | | | | | | | | | | | 0.60 | 0.18 | 0.11 | 0.11 | | |
| BDL142 | 8284.1 | Av | | | | | | | | | | | | 1.10 | 1.17 | 1.47 | 1.36 | | |
| BDL142 | 8285.1 | P | | 0.07 | | 0.22 | 0.06 | 0.03 | 0.08 | 0.00 | 0.01 | 0.19 | | | | 0.42 | | | |
| BDL142 | 8285.1 | Av | | 1.51 | | 1.22 | 1.35 | 1.36 | 2.43 | 2.18 | 1.75 | 2.62 | | | | 1.22 | | | |
| BDL142 | 8285.3 | P | | | | | | | | | | 0.18 | | 0.13 | 0.65 | 0.06 | 0.19 | | |
| BDL142 | 8285.3 | Av | | | | | | | | | | 1.22 | | 1.65 | 1.13 | 1.89 | 1.24 | | |
| BDL142 | 8285.5 | P | | | 0.48 | | 0.38 | | 0.15 | 0.42 | | | 0.33 | | | 0.60 | | | |

TABLE 23-continued

Results obtained in a tissue culture assay

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL142 | 8285.5 | Av | | | 1.11 | | 1.11 | | 1.29 | 1.15 | | | 1.22 | | | 1.11 | | | |
| BDL143 | 8411.1 | P | | | | | | | | | | | | 0.22 | 0.31 | 0.02 | 0.02 | | |
| BDL143 | 8411.1 | Av | | | | | | | | | | | | 1.51 | 1.22 | 2.08 | 1.50 | | |
| BDL143 | 8412.2 | P | | | | | | | | | | | | 0.28 | | 0.08 | | | |
| BDL143 | 8412.2 | Av | | | | | | | | | | | | 1.59 | | 2.30 | | | |
| BDL143 | 8413.3 | P | | | | | | | | | | 0.04 | | 0.49 | 0.14 | 0.43 | 0.23 | | |
| BDL143 | 8413.3 | Av | | | | | | | | | | 1.49 | | 1.22 | 1.39 | 1.31 | 1.30 | | |
| BDL143 | 8414.4 | P | | | | | | | | | | | | 0.69 | 0.17 | 0.59 | 0.01 | | |
| BDL143 | 8414.4 | Av | | | | | | | | | | | | 1.27 | 1.42 | 1.25 | 1.84 | | |
| BDL143 | 8414.5 | P | | | | | | | | | | 0.17 | 0.31 | | 0.42 | 0.12 | | | |
| BDL143 | 8414.5 | Av | | | | | | | | | | 1.28 | 1.21 | | 1.10 | 1.40 | | | |
| BDL144 | 8381.3 | P | | | | | | | | | | 0.53 | | | 0.03 | | 0.11 | | |
| BDL144 | 8381.3 | Av | | | | | | | | | | 1.15 | | | 1.85 | | 1.39 | | |
| BDL144 | 8382.2 | P | 0.22 | 0.24 | 0.40 | | | | | | 0.45 | 0.36 | | 0.16 | 0.32 | 0.08 | | 0.01 | 0.20 |
| BDL144 | 8382.2 | Av | 1.36 | 1.61 | 1.34 | | | | | | 1.37 | 1.31 | | 2.95 | 1.30 | 1.73 | | 1.55 | 1.20 |
| BDL144 | 8384.4 | P | | 0.04 | | | | | | | | 0.33 | | 0.01 | | 0.01 | | | |
| BDL144 | 8384.4 | Av | | 1.42 | | | | | | | | 2.46 | | 2.51 | | 1.97 | | | |
| BDL144 | 8385.1 | P | | | | | | | | | | 0.13 | | 0.06 | 0.02 | 0.27 | 0.03 | | |
| BDL144 | 8385.1 | Av | | | | | | | | | | 1.59 | | 1.51 | 2.26 | 1.36 | 1.60 | | |
| BDL145 | 8233.2 | P | | | | | | | | | | | | 0.08 | | 0.11 | 0.00 | | |
| BDL145 | 8233.2 | Av | | | | | | | | | | | | 1.39 | | 1.61 | 1.42 | | |
| BDL145 | 8233.3 | P | | | | | | | | | | | 0.57 | 0.24 | 0.21 | 0.04 | 0.00 | | |
| BDL145 | 8233.3 | Av | | | | | | | | | | | 1.12 | 1.71 | 1.43 | 2.15 | 1.51 | | |
| BDL145 | 8235.3 | P | | | | | | | | | | | 0.40 | 0.31 | | 0.01 | | | |
| BDL145 | 8235.3 | Av | | | | | | | | | | | 1.18 | 1.34 | | 1.55 | | | |
| BDL145 | 8731.3 | P | | | | | | | | | | | 0.81 | 0.41 | 0.47 | 0.12 | 0.21 | | |
| BDL145 | 8731.3 | Av | | | | | | | | | | | 1.12 | 1.45 | 1.36 | 1.60 | 1.52 | | |
| BDL145 | 8734.2 | P | | | | | | | | | | | | 0.09 | 0.32 | 0.02 | 0.00 | | |
| BDL145 | 8734.2 | Av | | | | | | | | | | | | 2.95 | 1.16 | 2.57 | 1.38 | | |
| BDL146 | 8241.1 | P | | 0.11 | 0.03 | | | | | | | 0.07 | 0.67 | 0.06 | 0.01 | 0.08 | 0.00 | 0.08 | 0.64 |
| BDL146 | 8241.1 | Av | | 1.18 | 1.28 | | | | | | | 1.20 | 1.12 | 1.85 | 1.52 | 1.50 | 1.52 | 1.37 | 1.11 |
| BDL146 | 8241.3 | P | | | | | | | | | | 0.06 | 0.17 | 0.25 | 0.01 | | 0.00 | | |
| BDL146 | 8241.3 | Av | | | | | | | | | | 1.45 | 1.23 | 1.18 | 4.78 | | 3.57 | | |
| BDL146 | 8244.4 | P | 0.00 | 0.01 | 0.04 | | | | | | | | | 0.03 | 0.53 | 0.09 | 0.06 | 0.02 | |
| BDL146 | 8244.4 | Av | 1.76 | 1.74 | 1.66 | | | | | | | | | 1.45 | 1.45 | 1.43 | 1.52 | 1.78 | |
| BDL146 | 8244.7 | P | | | | | | | | | | 0.12 | 0.31 | 0.00 | 0.05 | 0.01 | 0.02 | | |
| BDL146 | 8244.7 | Av | | | | | | | | | | 1.57 | 1.15 | 2.44 | 2.61 | 2.07 | 2.32 | | |
| BDL146 | 8245.5 | P | 0.02 | 0.01 | 0.01 | | | | | | | 0.22 | | | 0.40 | | 0.00 | 0.13 | |
| BDL146 | 8245.5 | Av | 1.23 | 1.43 | 1.32 | | | | | | | 1.26 | | | 1.12 | | 1.33 | 1.32 | |
| BDL42 | 7771.3 | P | | 0.20 | 0.01 | | 0.29 | 0.06 | | 0.41 | 0.04 | 0.17 | 0.01 | 0.17 | 0.18 | 0.02 | | 0.04 | 0.09 |
| BDL42 | 7771.3 | Av | | 1.14 | 1.50 | | 1.15 | 1.25 | | 1.27 | 1.67 | 1.34 | 1.55 | 2.06 | 1.37 | 1.80 | | 1.30 | 1.36 |
| BDL42 | 7771.5 | P | | | | | | | | | | 0.43 | 0.05 | | 0.12 | | 0.00 | | |
| BDL42 | 7771.5 | Av | | | | | | | | | | 1.51 | 1.15 | | 3.36 | | 1.69 | | |
| BDL42 | 7772.6 | P | | | | 0.00 | | | 0.00 | | | 0.01 | | | | | | 0.10 | |
| BDL42 | 7772.6 | Av | | | | 1.85 | | | 3.31 | | | 1.43 | | | | | | 1.34 | |
| BDL42 | 7774.1 | P | | | | | | | | | | | 0.01 | | 0.01 | | 0.02 | | |
| BDL42 | 7774.1 | Av | | | | | | | | | | | 1.57 | | 4.16 | | 2.03 | | |
| BDL42 | 7774.5 | P | | | | | | 0.55 | | | 0.63 | | 0.02 | 0.20 | 0.24 | 0.06 | 0.44 | | |
| BDL42 | 7774.5 | Av | | | | | | 1.11 | | | 1.14 | | 1.56 | 2.36 | 1.66 | 2.21 | 1.23 | | |
| BDL51 | 8021.1 | P | | | | | | | | | | | 0.25 | | 0.01 | | 0.01 | | |
| BDL51 | 8021.1 | Av | | | | | | | | | | | 1.14 | | 1.92 | | 1.50 | | |
| BDL51 | 8022.4 | P | | | | | | | | | | | 0.06 | | 0.02 | | 0.01 | | |
| BDL51 | 8022.4 | Av | | | | | | | | | | | 1.15 | | 1.80 | | 1.59 | | |
| BDL51 | 8022.5 | P | | | | | | | | | | 0.24 | 0.00 | | 0.06 | | 0.00 | | |
| BDL51 | 8022.5 | Av | | | | | | | | | | 1.11 | 1.27 | | 2.05 | | 1.84 | | |
| BDL51 | 8022.7 | P | | 0.08 | | 0.00 | 0.18 | 0.25 | 0.00 | 0.02 | 0.03 | 0.34 | | | | | | 0.16 | |
| BDL51 | 8022.7 | Av | | 1.22 | | 1.80 | 1.18 | 1.14 | 3.36 | 1.71 | 1.53 | 1.30 | | | | | | 1.34 | |
| BDL51 | 8024.4 | P | | | | | | | | | | 0.02 | | | 0.46 | | 0.04 | | |
| BDL51 | 8024.4 | Av | | | | | | | | | | 1.20 | | | 1.25 | | 1.38 | | |
| BDL51 | 8024.7 | P | | | | | | | 0.02 | | | | | | 0.05 | | 0.02 | | |
| BDL51 | 8024.7 | Av | | | | | | | 1.34 | | | | | | 1.45 | | 1.39 | | |
| BDL52 | 7861.1 | P | 0.05 | | 0.44 | | | | | | | | 0.08 | 0.10 | 0.12 | 0.02 | 0.04 | | 0.38 |
| BDL52 | 7861.1 | Av | 1.26 | | 1.20 | | | | | | | | 1.73 | 3.22 | 1.90 | 2.82 | 1.37 | | 1.19 |
| BDL52 | 7863.2 | P | 0.00 | | 0.55 | | | | | | | | 0.52 | 0.16 | | 0.29 | | | 0.08 |
| BDL52 | 7863.2 | Av | 1.42 | | 1.14 | | | | | | | | 1.17 | 1.31 | | 1.32 | | | 1.47 |
| BDL52 | 7864.2 | P | 0.10 | | | | | | | | | | | 0.26 | 0.57 | 0.22 | | | |
| BDL52 | 7864.2 | Av | 1.22 | | | | | | | | | | | 3.45 | 1.10 | 2.55 | | | |
| BDL52 | 7864.3 | P | | | | 0.00 | 0.27 | | 0.01 | 0.41 | 0.46 | | | | | | | | |
| BDL52 | 7864.3 | Av | | | | 1.28 | 1.11 | | 1.76 | 1.16 | 1.12 | | | | | | | | |
| BDL52 | 7864.5 | P | 0.27 | 0.47 | | | | | | | | | | | 0.10 | | | | |
| BDL52 | 7864.5 | Av | 1.19 | 1.10 | | | | | | | | | | | 1.12 | | | | |
| BDL59 | 7792.1 | P | | | | | | | | | | | | | | | | | |
| BDL59 | 7792.1 | Av | | | | | | | | | | | | | | | | | |
| BDL59 | 7792.2 | P | | | | | | | | | | | | 0.20 | | | | | |
| BDL59 | 7792.2 | Av | | | | | | | | | | | | 1.27 | | | | | |
| BDL59 | 7792.3 | P | | | | | | | | | | | | | | | | | |

TABLE 23-continued

Results obtained in a tissue culture assay

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL59 | 7792.3 | Av | | | | | | | | | | | | | | | | | |
| BDL59 | 7793.3 | P | | | | | | | | | | 0.01 | | 0.00 | | 0.04 | | | |
| BDL59 | 7793.3 | Av | | | | | | | | | | 1.76 | | 1.65 | | 1.45 | | | |
| BDL59 | 7794.1 | P | | | | | | | | | | 0.12 | | | | | | | |
| BDL59 | 7794.1 | Av | | | | | | | | | | 1.15 | | | | | | | |
| BDL65 | 7824.1 | P | | | | | | | | | | | | | 0.08 | | 0.11 | | |
| BDL65 | 7824.1 | Av | | | | | | | | | | | | | 1.79 | | 1.37 | | |
| BDL65 | 7825.2 | P | 0.18 | | | | | | | | | | | | | | | | 0.48 |
| BDL65 | 7825.2 | Av | 1.12 | | | | | | | | | | | | | | | | 1.16 |
| BDL65 | 8761.1 | P | | | | | | | | | | | | 0.16 | | 0.07 | 0.04 | | 0.66 |
| BDL65 | 8761.1 | Av | | | | | | | | | | | | 2.09 | | 1.51 | 1.39 | | 1.11 |
| BDL65 | 8762.3 | P | 0.10 | | | | | | | | | | | | | | | 0.15 | 0.70 |
| BDL65 | 8762.3 | Av | 1.14 | | | | | | | | | | | | | | | 1.27 | 1.15 |
| BDL65 | 8764.1 | P | | | | | | | | | | | | 0.08 | 0.03 | 0.39 | 0.00 | 0.39 | |
| BDL65 | 8764.1 | Av | | | | | | | | | | | | 1.42 | 1.81 | 1.10 | 1.98 | 1.46 | |
| BDL67 | 7901.5 | P | | | | | | | | | | | | | 0.18 | | 0.16 | | |
| BDL67 | 7901.5 | Av | | | | | | | | | | | | | 1.71 | | 1.58 | | |
| BDL67 | 7902.3 | P | | | | | | | | | | | 0.07 | | 0.10 | | 0.00 | | |
| BDL67 | 7902.3 | Av | | | | | | | | | | | 1.20 | | 1.22 | | 1.49 | | |
| BDL67 | 7902.7 | P | | | | | | | | | | | 0.06 | 0.03 | 0.50 | 0.08 | 0.35 | | 0.27 |
| BDL67 | 7902.7 | Av | | | | | | | | | | | 1.42 | 5.05 | 1.16 | 4.84 | 1.19 | | 1.23 |
| BDL67 | 7903.3 | P | | | | | | | | | | | | | 0.00 | | 0.19 | | |
| BDL67 | 7903.3 | Av | | | | | | | | | | | | | 1.40 | | 1.21 | | |
| BDL67 | 7903.5 | P | 0.01 | | | | | | | | | | 0.01 | 0.29 | | 0.02 | | | |
| BDL67 | 7903.5 | Av | 1.26 | | | | | | | | | | 1.34 | 1.35 | | 2.25 | | | |
| BDL68 | 7761.3 | P | | | | 0.11 | | | 0.24 | | | | | | | | | | |
| BDL68 | 7761.3 | Av | | | | 1.16 | | | 1.13 | | | | | | | | | | |
| BDL68 | 7761.5 | P | | | | | | | | | | | | 0.02 | | 0.01 | 0.68 | | |
| BDL68 | 7761.5 | Av | | | | | | | | | | | | 1.79 | | 1.42 | 1.16 | | |
| BDL68 | 7761.9 | P | | | | | | | | | | | | | | | | | |
| BDL68 | 7761.9 | Av | | | | | | | | | | | | | | | | | |
| BDL68 | 7764.1 | P | | | | | | | | | | 0.49 | | | | | | | |
| BDL68 | 7764.1 | Av | | | | | | | | | | 1.16 | | | | | | | |
| BDL68 | 7765.2 | P | | | | | | 0.11 | | | 0.10 | 0.03 | | 0.26 | 0.25 | | 0.22 | | |
| BDL68 | 7765.2 | Av | | | | | | 1.23 | | | 1.51 | 1.84 | | 1.40 | 1.43 | | 1.37 | | |
| BDL78 | 7911.11 | P | | 0.47 | 0.27 | | | 0.07 | | | 0.18 | 0.01 | 0.24 | | 0.04 | | 0.01 | | |
| BDL78 | 7911.11 | Av | | 1.10 | 1.16 | | | 1.16 | | | 1.19 | 1.58 | 1.16 | | 1.24 | | 1.36 | | |
| BDL78 | 7911.8 | P | | | 0.53 | | | | | | | | 0.04 | 0.05 | 0.22 | 0.05 | 0.08 | 0.09 | |
| BDL78 | 7911.8 | Av | | | 1.12 | | | | | | | | 1.31 | 2.55 | 1.36 | 1.87 | 1.47 | 1.63 | |
| BDL78 | 7912.6 | P | | 0.00 | 0.03 | | | | | | | 0.44 | 0.29 | 0.22 | 0.04 | 0.00 | 0.00 | 0.53 | |
| BDL78 | 7912.6 | Av | | 1.16 | 1.25 | | | | | | | 1.13 | 1.23 | 2.15 | 1.85 | 1.30 | 1.82 | 1.16 | |
| BDL78 | 7913.6 | P | | | | | | | | | | | 0.61 | 0.27 | 0.20 | 0.20 | 0.47 | | |
| BDL78 | 7913.6 | Av | | | | | | | | | | | 1.16 | 1.83 | 1.50 | 1.35 | 1.16 | | |
| BDL78 | 7913.8 | P | | 0.34 | 0.43 | | | | | | | 0.01 | | | 0.11 | | 0.02 | | 0.39 |
| BDL78 | 7913.8 | Av | | 1.14 | 1.13 | | | | | | | 1.57 | | | 1.28 | | 1.39 | | 4.27 |
| BDL78 | 7913.9 | P | | | | | | | | | | | | 0.00 | | 0.05 | 0.08 | 0.22 | |
| BDL78 | 7913.9 | Av | | | | | | | | | | | | 2.56 | | 1.75 | 1.56 | 1.40 | |
| BDL82 | 7801.1 | P | | | | | | | | | | | | | 0.05 | | 0.00 | | |
| BDL82 | 7801.1 | Av | | | | | | | | | | | | | 1.97 | | 1.57 | | |
| BDL82 | 7801.2 | P | | | | | | | | | | 0.11 | 0.21 | 0.83 | | 0.33 | | | |
| BDL82 | 7801.2 | Av | | | | | | | | | | 1.13 | 1.14 | 1.12 | | 1.33 | | | |
| BDL82 | 7801.3 | P | | | | | | | | | | | 0.00 | | 0.20 | | 0.01 | | |
| BDL82 | 7801.3 | Av | | | | | | | | | | | 1.32 | | 1.78 | | 1.69 | | |
| BDL82 | 7801.3 | P | | | | | | | | | | | 0.09 | | 0.00 | | 0.02 | | |
| BDL82 | 7801.3 | Av | | | | | | | | | | | 2.47 | | 5.03 | | 2.49 | | |
| BDL82 | 7802.2 | P | | | | | | | | | | | 0.00 | | 0.02 | | 0.00 | | |
| BDL82 | 7802.2 | Av | | | | | | | | | | | 1.62 | | 3.16 | | 2.56 | | |
| BDL82 | 7802.2 | P | | | | | | | | | | | 0.58 | | | | | | |
| BDL82 | 7802.2 | Av | | | | | | | | | | | 1.11 | | | | | | |
| BDL82 | 7802.3 | P | | | | | | | | | | | 0.22 | | 0.07 | | 0.02 | | |
| BDL82 | 7802.3 | Av | | | | | | | | | | | 1.33 | | 1.67 | | 1.46 | | |
| BDL82 | 7803.4 | P | | | | | | | | | | | | | 0.11 | 0.28 | 0.03 | | |
| BDL82 | 7803.4 | Av | | | | | | | | | | | | | 1.51 | 1.28 | 1.36 | | |
| BDL82 | 7803.8 | P | | | | | | | | | | | 0.11 | | 0.12 | | 0.03 | 0.41 | 0.40 |
| BDL82 | 7803.8 | Av | | | | | | | | | | | 1.55 | | 1.90 | | 2.13 | 1.37 | 1.15 |
| BDL82 | 7803.9 | P | | | | | | | | | | 0.00 | 0.06 | 0.33 | 0.35 | | 0.37 | 0.41 | 0.01 |
| BDL82 | 7803.9 | Av | | | | | | | | | | 1.27 | 1.27 | 1.15 | 1.33 | | 1.34 | 1.16 | 1.17 |
| BDL82 | 7803.9 | P | | | | | | | | | | | 0.31 | 0.12 | 0.16 | 0.05 | 0.43 | | |
| BDL82 | 7803.9 | Av | | | | | | | | | | | 1.12 | 2.57 | 1.28 | 2.36 | 1.13 | | |
| BDL82 | 7808.6 | P | 0.00 | 0.02 | 0.05 | | | 0.04 | | | 0.10 | | | 0.14 | 0.17 | 0.08 | 0.08 | | |
| BDL82 | 7808.6 | Av | 1.50 | 1.18 | 1.22 | | | 1.29 | | | 1.42 | | | 2.35 | 1.48 | 2.32 | 1.26 | | |
| BDL89 | 7812.2 | P | | | | | | | | | | | 0.07 | 0.00 | 0.00 | 0.01 | 0.00 | | |
| BDL89 | 7812.2 | Av | | | | | | | | | | | 1.16 | 1.75 | 1.41 | 1.50 | 1.35 | | |
| BDL89 | 7812.5 | P | | | | | | | | | | | 0.16 | | 0.04 | | 0.01 | | |
| BDL89 | 7812.5 | Av | | | | | | | | | | | 1.43 | | 3.01 | | 2.30 | | |
| BDL89 | 7814.1 | P | | | | | | | | | | | 0.05 | 0.64 | 0.07 | | 0.07 | | |

TABLE 23-continued

| Results obtained in a tissue culture assay | | | | | | | | | | | | | | | | | | | |
|---|---|---|---|---|---|---|---|---|---|---|---|---|---|---|---|---|---|---|---|
| Gene | Ev. | Par. | 1 | 2 | 3 | 4 | 5 | 6 | 7 | 8 | 9 | 10 | 11 | 12 | 13 | 14 | 15 | 16 | 17 |
| BDL89 | 7814.1 | Av | | | | | | | | | | | 1.17 | 1.13 | 1.60 | | 1.57 | | |
| BDL89 | 7814.4 | P | | | | | | | | | | 0.19 | | | 0.12 | | 0.12 | | |
| BDL89 | 7814.4 | Av | | | | | | | | | | 1.40 | | | 1.39 | | 1.39 | | |
| BDL89 | 7814.5 | P | | | | | | | | | | 0.11 | 0.28 | 0.41 | 0.02 | 0.37 | 0.05 | | |
| BDL89 | 7814.5 | Av | | | | | | | | | | 1.30 | 1.16 | 2.04 | 2.01 | 1.21 | 1.68 | | |
| BDL95 | 7841.2 | P | | | | | | | | | | | 0.03 | 0.55 | 0.16 | 0.70 | 0.08 | | |
| BDL95 | 7841.2 | Av | | | | | | | | | | | 1.21 | 1.23 | 1.40 | 1.10 | 1.37 | | |
| BDL95 | 7842.12 | P | | | 0.41 | | | | | | | 0.02 | 0.10 | 0.31 | 0.17 | 0.36 | 0.02 | | |
| BDL95 | 7842.12 | Av | | | 1.12 | | | | | | | 1.26 | 1.26 | 1.28 | 1.27 | 1.17 | 1.46 | | |
| BDL95 | 7842.2 | P | | | | | | | | | | 0.11 | | | 0.34 | | 0.00 | | |
| BDL95 | 7842.2 | Av | | | | | | | | | | 1.30 | | | 1.19 | | 1.34 | | |
| BDL95 | 7842.8 | P | | | | | | | | | | 0.18 | 0.14 | | 0.00 | 0.33 | 0.06 | | |
| BDL95 | 7842.8 | Av | | | | | | | | | | 1.22 | 1.22 | | 1.63 | 1.19 | 1.49 | | |
| BDL95 | 7843.4 | P | | | | | | | | | | | 0.02 | | 0.04 | | 0.01 | | |
| BDL95 | 7843.4 | Av | | | | | | | | | | | 1.58 | | 2.93 | | 2.20 | | |

Table 23.
"P" = P-value;
"Av" = ratio between the averages of event and control. Note that when the average ratio is higher than "1" the effect of exogenous expression of the gene is an increase of the desired trait;
"Par" = Parameter according to the parameters listed in Table 22 above;
"Ev" = event.

Greenhouse assays—Tables 25, 26 and 27 represent experiments that were done using greenhouse assays. Table 24 specifies the parameters that were measured in the green house assays and which are presented in Tables 25, 26 and 27. In cases where a certain event appears more than once, the event was tested in several independent experiments.

TABLE 24

| Parameter symbol in result Tables 25, 26 and 27 | Parameter name |
|---|---|
| 1 | Rosette Diameter Time point 1 |
| 2 | Rosette Diameter Time point 2 |
| 3 | Rosette Diameter Time point 3 |
| 4 | Rosette Diameter Time point 4 |
| 5 | Rosette Area Time point 1 |
| 6 | Rosette Area Time point 2 |
| 7 | Rosette Area Time point 3 |
| 8 | Rosette Area Time point 4 |
| 9 | Plot Coverage Time point 1 |
| 10 | Plot Coverage Time point 2 |
| 11 | Plot Coverage Time point 3 |
| 12 | Plot Coverage Time point 4 |
| 13 | Leaf Number Time point 1 |
| 14 | Leaf Number Time point 2 |
| 15 | Leaf Number Time point 3 |
| 16 | Leaf Number Time point 4 |
| 17 | Leaf Blade Area Time point 1 |
| 18 | Leaf Blade Area Time point 2 |
| 19 | Leaf Blade Area Time point 3 |
| 20 | Leaf Blade Area Time point 4 |
| 21 | Leaf Petiole Area Time point 1 |
| 22 | Leaf Petiole Area Time point 2 |
| 23 | Leaf Petiole Area Time point 3 |
| 24 | Leaf Petiole Area Time point 4 |
| 25 | Blade Relative Area Time point 1 |
| 26 | Blade Relative Area Time point 2 |
| 27 | Blade Relative Area Time point 3 |
| 28 | Blade Relative Area Time point 4 |
| 29 | Petiole Relative Area Time point 1 |
| 30 | Petiole Relative Area Time point 2 |
| 31 | Petiole Relative Area Time point 3 |
| 32 | Petiole Relative Area Time point 4 |
| 33 | RGR of Leaf Blade Area Time point 2 |
| 34 | RGR of Leaf Blade Area Time point 3 |
| 35 | RGR of Leaf Blade Area Time point 4 |
| 36 | RGR of Leaf Number Time point 2 |
| 37 | RGR of Leaf Number Time point 3 |
| 38 | RGR of Leaf Number Time point 4 |
| 39 | RGR of Rosette Area Time point 2 |
| 40 | RGR of Rosette Area Time point 3 |
| 41 | RGR of Rosette Area Time point 4 |
| 42 | RGR of Rosette Diameter Time point 2 |
| 43 | RGR of Rosette Diameter Time point 3 |
| 44 | RGR of Rosette Diameter Time point 4 |

TABLE 24-continued

| Parameter symbol in result Tables 25, 26 and 27 | Parameter name |
|---|---|
| 45 | RGR of Plot Coverage Time point 2 |
| 46 | RGR of Plot Coverage Time point 3 |
| 47 | RGR of Plot Coverage Time point 4 |
| 48 | Bolting |
| 49 | Flowering |
| 50 | Dry Weight |
| 51 | Seed Yield |
| 52 | Harvest Index |
| 53 | 1000 Seeds Weight |
| 54 | oil content |
| 55 | Fresh Weight |

Table 24.

TABLE 25

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL95 | 7841.5 | P | | | | | | | | | | | | | | | | | |
| BDL95 | 7841.5 | Av. | | | | | | | | | | | | | | | | | |
| BDL95 | 7842.12 | P | | | | | | | | | | | | | | | | | |
| BDL95 | 7842.12 | Av. | | | | | | | | | | | | | | | | | |
| BDL95 | 7842.2 | P | | | | | | | | | | | | | | | | | 0.35 |
| BDL95 | 7842.2 | Av. | | | | | | | | | | | | | | | | | 1.12 |
| BDL95 | 7842.8 | P | | | | | | | | | | | | | | | | | |
| BDL95 | 7842.8 | Av. | | | | | | | | | | | | | | | | | |
| BDL95 | 7843.4 | P | | | | | | | | | | | | | | | | | |
| BDL95 | 7843.4 | Av. | | | | | | | | | | | | | | | | | |
| BDL100 | 7871.2 | P | | | | | | | | | | | | | | | | | |
| BDL100 | 7871.2 | Av. | | | | | | | | | | | | | | | | | |
| BDL100 | 7872.2 | P | | | | | | | | | | | | | | | | | |
| BDL100 | 7872.2 | Av. | | | | | | | | | | | | | | | | | |
| BDL100 | 7872.3 | P | | | 0.35 | | 0.31 | 0.53 | 0.33 | 0.10 | 0.31 | 0.53 | 0.33 | 0.10 | | | 0.23 | 0.02 | 0.23 |
| BDL100 | 7872.3 | Av. | | | 1.11 | | 1.38 | 1.21 | 1.19 | 1.20 | 1.38 | 1.21 | 1.19 | 1.20 | | | 1.13 | 1.08 | 1.38 |
| BDL100 | 7873.3 | P | | | | | | | | | | | | | | | | | |
| BDL100 | 7873.3 | Av. | | | | | | | | | | | | | | | | | |
| BDL100 | 7873.4 | P | 0.43 | | | | 0.23 | | 0.57 | 0.53 | 0.23 | | 0.57 | 0.53 | | | | | 0.39 |
| BDL100 | 7873.4 | Av. | 1.11 | | | | 1.23 | | 1.12 | 1.14 | 1.23 | | 1.12 | 1.14 | | | | | 1.15 |
| BDL106 | 7881.1 | P | | | | | | 0.24 | | | | 0.24 | | | | | | | |
| BDL106 | 7881.1 | Av. | | | | | | 1.13 | | | | 1.13 | | | | | | | |
| BDL106 | 7881.4 | P | | | | | | | | | | | | | | | | | |
| BDL106 | 7881.4 | Av. | | | | | | | | | | | | | | | | | |
| BDL106 | 7882.6 | P | | | | | | | | | | | | | | | | | |
| BDL106 | 7882.6 | Av. | | | | | | | | | | | | | | | | | |
| BDL106 | 7884.1 | P | | | | | | | | | | | | | | | | | |
| BDL106 | 7884.1 | Av. | | | | | | | | | | | | | | | | | |
| BDL106 | 7884.9 | P | | | | | | | | | | | | | | | | | |
| BDL106 | 7884.9 | Av. | | | | | | | | | | | | | | | | | |
| BDL106 | 7881.1 | P | | | | | | | | | | | | | | | | | |
| BDL106 | 7881.1 | Av. | | | | | | | | | | | | | | | | | |
| BDL106 | 7881.2 | P | | | | | | | | | | | | | | | | | |
| BDL106 | 7881.2 | Av. | | | | | | | | | | | | | | | | | |
| BDL106 | 7882.2 | P | | | | | 0.79 | | | | 0.79 | | | | | | | | 0.04 |
| BDL106 | 7882.2 | Av. | | | | | 1.13 | | | | 1.13 | | | | | | | | 1.17 |
| BDL106 | 7882.4 | P | | | | | | | | | | | | | | | | | |
| BDL106 | 7882.4 | Av. | | | | | | | | | | | | | | | | | |
| BDL106 | 7882.5 | P | | | | | | | | | | | | | | | | | |
| BDL106 | 7882.5 | Av. | | | | | | | | | | | | | | | | | |
| BDL108 | 8122.2 | P | | | | | | | | | | | | | | | | | |
| BDL108 | 8122.2 | Av. | | | | | | | | | | | | | | | | | |
| BDL108 | 8122.3 | P | | | | | | | | | | | | | | 0.02 | | | 0.42 |
| BDL108 | 8122.3 | Av. | | | | | | | | | | | | | | 1.10 | | | 1.11 |
| BDL108 | 8123.1 | P | | | | | | | | | | | | | | | | | |
| BDL108 | 8123.1 | Av. | | | | | | | | | | | | | | | | | |
| BDL108 | 8123.2 | P | | | | | | | | | | | | | | | | | |
| BDL108 | 8123.2 | Av. | | | | | | | | | | | | | | | | | |
| BDL108 | 8123.5 | P | | | | | | | | | | | | | | | | | |
| BDL108 | 8123.5 | Av. | | | | | | | | | | | | | | | | | |
| BDL108 | 8121.1 | P | | | | | | | | | | | | | | | | | |
| BDL108 | 8121.1 | Av. | | | | | | | | | | | | | | | | | |
| BDL108 | 8121.3 | P | | | | | | | | | | | | | | | | | |
| BDL108 | 8121.3 | Av. | | | | | | | | | | | | | | | | | |
| BDL108 | 8121.4 | P | | | | | | | | | | | | | | | | | |
| BDL108 | 8121.4 | Av. | | | | | | | | | | | | | | | | | |
| BDL108 | 8122.7 | P | | | | | | | | | | | | | | | | | |
| BDL108 | 8122.7 | Av. | | | | | | | | | | | | | | | | | |
| BDL108 | 8123.7 | P | | | | | | | | | | | | | | | | | |
| BDL108 | 8123.7 | Av. | | | | | | | | | | | | | | | | | |

TABLE 25-continued

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL110 | 8092.1 | P | 0.46 | | 0.01 | | 0.56 | | | | 0.56 | | | | 0.46 | | | | |
| BDL110 | 8092.1 | Av. | 1.13 | | 1.43 | | 1.17 | | | | 1.17 | | | | 1.27 | | | | |
| BDL110 | 8092.2 | P | | | 0.15 | | | | | | | | | | | | | | |
| BDL110 | 8092.2 | Av. | | | 1.21 | | | | | | | | | | | | | | |
| BDL110 | 8092.5 | P | 0.10 | | 0.01 | | 0.28 | 0.00 | 0.30 | 0.11 | 0.53 | | | 0.05 | 0.10 | | | | |
| BDL110 | 8092.5 | Av. | 1.27 | | 1.52 | | 1.26 | 1.17 | 1.11 | 1.19 | 1.19 | | | 1.11 | 1.35 | | | | |
| BDL110 | 8095.2 | P | | | 0.01 | | 0.21 | | | | 0.21 | | | | 0.05 | | | | |
| BDL110 | 8095.2 | Av. | | | 1.44 | | 1.23 | | | | 1.23 | | | | 1.45 | | | | |
| BDL111 | 8102.7 | P | | | | | | | | | | | | | | | | | |
| BDL111 | 8102.7 | Av. | | | | | | | | | | | | | | | | | |
| BDL111 | 8103.1 | P | | | | | | | | | | | | | | | | | |
| BDL111 | 8103.1 | Av. | | | | | | | | | | | | | | | | | |
| BDL111 | 8103.2 | P | | | | | | | | | | | | | | | | | |
| BDL111 | 8103.2 | Av. | | | | | | | | | | | | | | | | | |
| BDL111 | 8103.4 | P | | | | | | | | | | | | | | | | | |
| BDL111 | 8103.4 | Av. | | | | | | | | | | | | | | | | | |
| BDL111 | 8103.5 | P | | | | | | | | | | | | | | | | 0.04 | |
| BDL111 | 8103.5 | Av. | | | | | | | | | | | | | | | | 1.04 | |
| BDL111 | 8102.7 | P | | | | | | | | | | | | | | | | | |
| BDL111 | 8102.7 | Av. | | | | | | | | | | | | | | | | | |
| BDL111 | 8103.1 | P | 0.41 | | 0.56 | 0.39 | | 0.67 | | 0.55 | | 0.67 | | 0.55 | | | | | |
| BDL111 | 8103.1 | Av. | 1.11 | | 1.13 | 1.10 | | 1.12 | | 1.15 | | 1.12 | | 1.15 | | | | | |
| BDL111 | 8103.2 | P | | | | | | | | | | | | | | | | | |
| BDL111 | 8103.2 | Av. | | | | | | | | | | | | | | | | | |
| BDL111 | 8103.4 | P | | | | | | | | | | | | | | | | | |
| BDL111 | 8103.4 | Av. | | | | | | | | | | | | | | | | | |
| BDL111 | 8103.5 | P | | | | | | | | | | | | | | | | | |
| BDL111 | 8103.5 | Av. | | | | | | | | | | | | | | | | | |
| BDL112 | 7502.1 | P | | | | | | | | | | | | | | | | | |
| BDL112 | 7502.1 | Av. | | | | | | | | | | | | | | | | | |
| BDL112 | 7502.14 | P | | | | | | | | | | | | | | | | | |
| BDL112 | 7502.14 | Av. | | | | | | | | | | | | | | | | | |
| BDL112 | 7502.4 | P | | | | | | | | | | | | | | | | | |
| BDL112 | 7502.4 | Av. | | | | | | | | | | | | | | | | | |
| BDL112 | 7502.7 | P | | | | | | | | | | | | | | | | | |
| BDL112 | 7502.7 | Av. | | | | | | | | | | | | | | | | | |
| BDL112 | 7502.9 | P | | | | | | | | | | | | | | | | | |
| BDL112 | 7502.9 | Av. | | | | | | | | | | | | | | | | | |
| BDL112 | 7502.1 | P | | | | | | | | | | | | | | | | | 0.01 |
| BDL112 | 7502.1 | Av. | | | | | | | | | | | | | | | | | 1.36 |
| BDL112 | 7502.4 | P | | | | | | | | | | | | | | | | | |
| BDL112 | 7502.4 | Av. | | | | | | | | | | | | | | | | | |
| BDL112 | 7502.7 | P | | | | | | | | | | | | | | | | | |
| BDL112 | 7502.7 | Av. | | | | | | | | | | | | | | | | | |
| BDL112 | 7502.8 | P | | | | | | | | | | | | | | | | | |
| BDL112 | 7502.8 | Av. | | | | | | | | | | | | | | | | | |
| BDL112 | 7502.9 | P | | | | | | | | | | | | | | | | | |
| BDL112 | 7502.9 | Av. | | | | | | | | | | | | | | | | | |
| BDL113 | 7683.4 | P | | | | | | | | | | | | | | | | | |
| BDL113 | 7683.4 | Av. | | | | | | | | | | | | | | | | | |
| BDL113 | 7683.6 | P | | | | | | | | | | | | | | | | | |
| BDL113 | 7683.6 | Av. | | | | | | | | | | | | | | | | | |
| BDL113 | 7684.3 | P | | | | | | | | | | | | | | | | | |
| BDL113 | 7684.3 | Av. | | | | | | | | | | | | | | | | | |
| BDL113 | 7684.6 | P | | | | | | | | | | | | | | | | | |
| BDL113 | 7684.6 | Av. | | | | | | | | | | | | | | | | | |
| BDL113 | 7684.7 | P | | | | | | | | | | | | | | | | | |
| BDL113 | 7684.7 | Av. | | | | | | | | | | | | | | | | | |
| BDL113 | 7683.1 | P | | | | | | | | | | | | | | | | | |
| BDL113 | 7683.1 | Av. | | | | | | | | | | | | | | | | | |
| BDL113 | 7683.11 | P | | | | | | | | | | | | | | | | | |
| BDL113 | 7683.11 | Av. | | | | | | | | | | | | | | | | | |
| BDL113 | 7683.4 | P | | | | | | | | | | | | | | | | | |
| BDL113 | 7683.4 | Av. | | | | | | | | | | | | | | | | | |
| BDL113 | 7684.1 | P | | | | | | | | | | | | | | | | | |
| BDL113 | 7684.1 | Av. | | | | | | | | | | | | | | | | | |
| BDL113 | 7684.5 | P | | | | | | | | | | | | | | | | | |
| BDL113 | 7684.5 | Av. | | | | | | | | | | | | | | | | | |
| BDL114 | 7741.3 | P | | | | | | | | | | | | | | | | | |
| BDL114 | 7741.3 | Av. | | | | | | | | | | | | | | | | | |
| BDL114 | 7741.6 | P | | | | | | | | | | | | | | | | | 0.44 |
| BDL114 | 7741.6 | Av. | | | | | | | | | | | | | | | | | 1.10 |
| BDL114 | 7742.1 | P | | | | | | | | | | | | | | | | | |
| BDL114 | 7742.1 | Av. | | | | | | | | | | | | | | | | | |
| BDL114 | 7742.3 | P | | | | | | | | | | | | | | | | | |
| BDL114 | 7742.3 | Av. | | | | | | | | | | | | | | | | | |
| BDL114 | 7742.5 | P | | | | | | | | | | | | | | | | | |
| BDL114 | 7742.5 | Av. | | | | | | | | | | | | | | | | | |

TABLE 25-continued

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL115 | 8152.3 | P | 0.09 | | | | | | | | | | | | | | | | |
| BDL115 | 8152.3 | Av. | 1.13 | | | | | | | | | | | | | | | | |
| BDL115 | 8152.4 | P | | | | | | 0.18 | | 0.24 | | | | | | | | 0.06 | |
| BDL115 | 8152.4 | Av. | | | | | | 1.13 | | 1.12 | | | | | | | | 1.13 | |
| BDL115 | 8154.1 | P | | | | | | | | | | | | | | | | | |
| BDL115 | 8154.1 | Av. | | | | | | | | | | | | | | | | | |
| BDL115 | 8155.2 | P | | | | | | | | | | | | | | | | | 0.46 |
| BDL115 | 8155.2 | Av. | | | | | | | | | | | | | | | | | 1.11 |
| BDL115 | 8155.4 | P | | | | | | | | | | | | | | | | | |
| BDL115 | 8155.4 | Av. | | | | | | | | | | | | | | | | | |
| BDL115 | 8152.3 | P | | | | | | | | | | | | | | | | | |
| BDL115 | 8152.3 | Av. | | | | | | | | | | | | | | | | | |
| BDL115 | 8152.4 | P | | | | | | | | | | | | | | | | | |
| BDL115 | 8152.4 | Av. | | | | | | | | | | | | | | | | | |
| BDL115 | 8154.1 | P | | | | | | | | | | | | | | | | | |
| BDL115 | 8154.1 | Av. | | | | | | | | | | | | | | | | | |
| BDL115 | 8155.2 | P | | | | | | | | | | | | | | | | | |
| BDL115 | 8155.2 | Av. | | | | | | | | | | | | | | | | | |
| BDL115 | 8155.4 | P | 0.06 | | | | | | | | | | | | | | | | |
| BDL115 | 8155.4 | Av. | 1.15 | | | | | | | | | | | | | | | | |
| BDL116 | 7481.2 | P | | | | | | | | | | | | | | | | | |
| BDL116 | 7481.2 | Av. | | | | | | | | | | | | | | | | | |
| BDL116 | 7481.7 | P | | | | | | | | | | | | | | | | | |
| BDL116 | 7481.7 | Av. | | | | | | | | | | | | | | | | | |
| BDL116 | 7481.8 | P | | | | | | | | | | | | | | | | | |
| BDL116 | 7481.8 | Av. | | | | | | | | | | | | | | | | | |
| BDL116 | 7482.2 | P | | | | | | | | | | | | | | | | | |
| BDL116 | 7482.2 | Av. | | | | | | | | | | | | | | | | | |
| BDL116 | 7485.1 | P | | | | | | | | | | | | | | | | | |
| BDL116 | 7485.1 | Av. | | | | | | | | | | | | | | | | | |
| BDL119 | 7732.2 | P | | | 0.41 | | | | | | | | | | | | | | |
| BDL119 | 7732.2 | Av. | | | 1.16 | | | | | | | | | | | | | | |
| BDL119 | 7733.2 | P | | | 0.18 | | | | | | | | | | | | | | |
| BDL119 | 7733.2 | Av. | | | 1.20 | | | | | | | | | | | | | | |
| BDL119 | 7734.1 | P | | | | | | | | | | | | | | | | | |
| BDL119 | 7734.1 | Av. | | | | | | | | | | | | | | | | | |
| BDL119 | 7734.5 | P | | | 0.08 | | | | | | | | | | | | | | |
| BDL119 | 7734.5 | Av. | | | 1.26 | | | | | | | | | | | | | | |
| BDL119 | 7734.7 | P | 0.07 | | 0.00 | 0.08 | | | 0.64 | 0.39 | | | 0.64 | 0.39 | 0.53 | | | | |
| BDL119 | 7734.7 | Av. | 1.33 | | 1.57 | 1.09 | | | 1.13 | 1.19 | | | 1.13 | 1.19 | 1.27 | | | | |
| BDL120 | 7891.3 | P | | | | | | | | | | | | | | | | | |
| BDL120 | 7891.3 | Av. | | | | | | | | | | | | | | | | | |
| BDL120 | 7892.4 | P | | | | | | | | | | | | | | | | | |
| BDL120 | 7892.4 | Av. | | | | | | | | | | | | | | | | | |
| BDL120 | 7892.6 | P | | | | | | | | | | | | | | | | | |
| BDL120 | 7892.6 | Av. | | | | | | | | | | | | | | | | | |
| BDL120 | 7893.2 | P | | | | | | | | | | | | | | | | | |
| BDL120 | 7893.2 | Av. | | | | | | | | | | | | | | | | | |
| BDL120 | 7893.5 | P | 0.14 | | | | 0.52 | 0.12 | 0.34 | 0.43 | 0.52 | 0.12 | 0.34 | 0.43 | | 0.26 | | 0.00 | 0.35 |
| BDL120 | 7893.5 | Av. | 1.18 | | | | 1.13 | 1.28 | 1.19 | 1.17 | 1.13 | 1.28 | 1.19 | 1.17 | | 1.14 | | 1.10 | 1.13 |
| BDL122 | 7513.1 | P | | | | | | | | | | | | | | | | | |
| BDL122 | 7513.1 | Av. | | | | | | | | | | | | | | | | | |
| BDL122 | 7513.1 | P | | | | | | | | | | | | | | 0.07 | | | |
| BDL122 | 7513.1 | Av. | | | | | | | | | | | | | | 1.09 | | | |
| BDL122 | 7513.14 | P | | | | | | | | | | | | | | | | | |
| BDL122 | 7513.14 | Av. | | | | | | | | | | | | | | | | | |
| BDL122 | 7513.9 | P | | | | | | | | | | | | | | | | | |
| BDL122 | 7513.9 | Av. | | | | | | | | | | | | | | | | | |
| BDL122 | 7514.3 | P | 0.25 | | 0.51 | 0.47 | 0.11 | | 0.27 | 0.28 | 0.20 | | 0.07 | 0.07 | 0.01 | | | | 0.33 |
| BDL122 | 7514.3 | Av. | 1.29 | | 1.18 | 1.14 | 1.35 | | 1.36 | 1.34 | 1.17 | | 1.17 | 1.15 | 1.25 | | | | 1.21 |
| BDL122 | 7513.1 | P | 0.02 | 0.06 | 0.08 | | 0.03 | 0.07 | 0.23 | 0.23 | 0.03 | 0.07 | 0.23 | 0.23 | 0.02 | | | | |
| BDL122 | 7513.1 | Av. | 1.18 | 1.13 | 1.13 | | 1.25 | 1.20 | 1.12 | 1.12 | 1.25 | 1.20 | 1.12 | 1.12 | 1.17 | | | | |
| BDL122 | 7513.14 | P | | | | | | | | | | | | | | | | | |
| BDL122 | 7513.14 | Av. | | | | | | | | | | | | | | | | | |
| BDL122 | 7513.9 | P | 0.28 | | | | | 0.19 | | | | 0.19 | | | | | | | |
| BDL122 | 7513.9 | Av. | 1.14 | | | | | 1.12 | | | | 1.12 | | | | | | | |
| BDL122 | 7514.3 | P | | | | | | | | | | | | | | | | | |
| BDL122 | 7514.3 | Av. | | | | | | | | | | | | | | | | | |
| BDL123 | 8082.1 | P | 0.21 | | | | 0.32 | | 0.20 | 0.25 | 0.32 | | 0.20 | 0.25 | | | | | 0.26 |
| BDL123 | 8082.1 | Av. | 1.15 | | | | 1.21 | | 1.17 | 1.12 | 1.21 | | 1.17 | 1.12 | | | | | 1.20 |
| BDL123 | 8082.3 | P | 0.00 | | | | 0.00 | | 0.02 | 0.05 | 0.00 | | 0.02 | 0.05 | 0.01 | | 0.00 | | 0.00 |
| BDL123 | 8082.3 | Av. | 1.23 | | | | 1.32 | | 1.25 | 1.23 | 1.32 | | 1.25 | 1.23 | 1.26 | | 1.16 | | 1.18 |
| BDL123 | 8082.6 | P | 0.16 | | | | 0.24 | | | | 0.24 | | | | | | | 0.20 | |
| BDL123 | 8082.6 | Av. | 1.13 | | | | 1.11 | | | | 1.11 | | | | | | | 1.12 | |
| BDL123 | 8083.2 | P | | | | | | | | | | | | | | | | | |
| BDL123 | 8083.2 | Av. | | | | | | | | | | | | | | | | | |
| BDL123 | 8083.3 | P | 0.00 | 0.00 | 0.02 | | 0.00 | 0.00 | 0.00 | | 0.00 | 0.00 | 0.00 | | 0.03 | 0.29 | 0.01 | | 0.00 |
| BDL123 | 8083.3 | Av. | 1.33 | 1.19 | 1.18 | | 1.64 | 1.46 | 1.44 | | 1.64 | 1.46 | 1.44 | | 1.30 | 1.10 | 1.12 | | 1.46 |

TABLE 25-continued

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL124 | 8482.1 | P | | | | | | | | | | | | | | | | | |
| BDL124 | 8482.1 | Av. | | | | | | | | | | | | | | | | | |
| BDL125 | 7491.1 | P | 0.00 | | | | 0.08 | 0.34 | | 0.18 | 0.08 | 0.34 | | 0.18 | | | | | 0.00 |
| BDL125 | 7491.1 | Av. | 1.24 | | | | 1.29 | 1.23 | | 1.20 | 1.29 | 1.23 | | 1.20 | | | | | 1.28 |
| BDL125 | 7491.5 | P | | | | | 0.58 | | | | 0.58 | | | | | | | | 0.23 |
| BDL125 | 7491.5 | Av. | | | | | 1.13 | | | | 1.13 | | | | | | | | 1.12 |
| BDL125 | 7492.5 | P | | | | | | | | | | | | | | | | | |
| BDL125 | 7492.5 | Av. | | | | | | | | | | | | | | | | | |
| BDL125 | 7494.1 | P | | | | | | | | | | | | | | | | 0.00 | |
| BDL125 | 7494.1 | Av. | | | | | | | | | | | | | | | | 1.12 | |
| BDL125 | 7495.5 | P | | | | | | | | | | | | | | | | | |
| BDL125 | 7495.5 | Av. | | | | | | | | | | | | | | | | | |
| BDL128 | 7711.3 | P | 0.26 | | | | | | | | | | | | | | | | |
| BDL128 | 7711.3 | Av. | 1.14 | | | | | | | | | | | | | | | | |
| BDL128 | 8361.5 | P | | | | 0.07 | | | | 0.28 | | | | 0.28 | | | | 0.43 | |
| BDL128 | 8361.5 | Av. | | | | 1.10 | | | | 1.14 | | | | 1.14 | | | | 1.12 | |
| BDL128 | 8362.2 | P | 0.00 | 0.05 | 0.16 | | 0.02 | 0.23 | | | 0.25 | | | | 0.11 | | | 0.06 | 0.01 |
| BDL128 | 8362.2 | Av. | 1.21 | 1.10 | 1.12 | | 1.24 | 1.14 | | | 1.16 | | | | 1.18 | | | 1.08 | 1.15 |
| BDL128 | 8363.2 | P | | | | | | | | | | | | | | | | | |
| BDL128 | 8363.2 | Av. | | | | | | | | | | | | | | | | | |
| BDL128 | 8365.2 | P | | | | | | | | | | | | | | | | | |
| BDL128 | 8365.2 | Av. | | | | | | | | | | | | | | | | | |
| BDL129 | 7691.4 | P | | | | | | | | | | | | | | | | | |
| BDL129 | 7691.4 | Av. | | | | | | | | | | | | | | | | | |
| BDL129 | 7691.6 | P | | | | | | | | | | | | | | | | | |
| BDL129 | 7691.6 | Av. | | | | | | | | | | | | | | | | | |
| BDL129 | 7692.2 | P | 0.14 | | | | | | | | | | | | | | | 0.00 | 0.41 |
| BDL129 | 7692.2 | Av. | 1.11 | | | | | | | | | | | | | | | 1.12 | 1.15 |
| BDL129 | 7692.6 | P | | | | | | | | | | | | | | | | | |
| BDL129 | 7692.6 | Av. | | | | | | | | | | | | | | | | | |
| BDL129 | 7693.1 | P | | | | | | | | | | | | | | | | | |
| BDL129 | 7693.1 | Av. | | | | | | | | | | | | | | | | | |
| BDL130 | 7663.1 | P | | | 0.03 | | | | | | | | | | 0.53 | | | | |
| BDL130 | 7663.1 | Av. | | | 1.33 | | | | | | | | | | 1.15 | | | | |
| BDL130 | 7663.3 | P | | | | | | | | | | | | | | | | | |
| BDL130 | 7663.3 | Av. | | | | | | | | | | | | | | | | | |
| BDL130 | 7663.6 | P | | | 0.00 | | 0.73 | | | | | | | | 0.26 | | | | |
| BDL130 | 7663.6 | Av. | | | 1.49 | | 1.12 | | | | | | | | 1.37 | | | | |
| BDL130 | 7664.5 | P | 0.31 | | 0.02 | | 0.52 | | | | 0.66 | | | | 0.38 | | | | |
| BDL130 | 7664.5 | Av. | 1.17 | | 1.51 | | 1.28 | | | | 1.22 | | | | 1.40 | | | | |
| BDL131 | 7461.2 | P | 0.00 | | 0.20 | | 0.00 | 0.13 | 0.01 | 0.05 | 0.00 | 0.13 | 0.01 | 0.05 | | | | | 0.08 |
| BDL131 | 7461.2 | Av. | 1.21 | | 1.13 | | 1.41 | 1.13 | 1.34 | 1.26 | 1.41 | 1.13 | 1.34 | 1.26 | | | | | 1.53 |
| BDL131 | 7461.4 | P | 0.01 | | | | 0.01 | 0.05 | 0.05 | 0.17 | 0.22 | 0.24 | 0.41 | 0.58 | 0.47 | 0.01 | 0.02 | 0.06 | 0.02 |
| BDL131 | 7461.4 | Av. | 1.27 | | | | 1.42 | 1.18 | 1.19 | 1.18 | 1.33 | 1.11 | 1.12 | 1.11 | 1.12 | 1.12 | 1.09 | 1.08 | 1.38 |
| BDL131 | 7462.2 | P | 0.00 | 0.04 | 0.08 | 0.05 | 0.35 | 0.03 | 0.11 | 0.00 | 0.35 | 0.03 | 0.11 | 0.00 | 0.36 | 0.25 | | | 0.33 |
| BDL131 | 7462.2 | Av. | 1.37 | 1.21 | 1.15 | 1.11 | 1.43 | 1.50 | 1.39 | 1.31 | 1.43 | 1.50 | 1.39 | 1.31 | 1.14 | 1.17 | | | 1.40 |
| BDL131 | 7463.4 | P | 0.01 | | | | | | 0.13 | 0.15 | | | 0.13 | 0.15 | | | | 0.06 | 0.21 |
| BDL131 | 7463.4 | Av. | 1.13 | | | | | | 1.13 | 1.15 | | | 1.13 | 1.15 | | | | 1.04 | 1.12 |
| BDL131 | 7464.5 | P | | | | | | | | | | | | | | | | 0.05 | |
| BDL131 | 7464.5 | Av. | | | | | | | | | | | | | | | | 1.06 | |
| BDL132 | 7471.1 | P | 0.00 | 0.28 | 0.06 | 0.35 | | 0.30 | 0.11 | 0.22 | | 0.30 | 0.11 | 0.22 | | 0.43 | 0.09 | 0.02 | |
| BDL132 | 7471.1 | Av. | 1.27 | 1.22 | 1.20 | 1.12 | | 1.50 | 1.33 | 1.23 | | 1.50 | 1.33 | 1.23 | | 1.23 | 1.12 | 1.14 | |
| BDL132 | 7471.1 | P | 0.07 | 0.31 | 0.14 | | 0.56 | 0.28 | 0.09 | 0.07 | 0.56 | 0.28 | 0.09 | 0.07 | 0.19 | 0.08 | | | |
| BDL132 | 7471.4 | Av. | 1.08 | 1.11 | 1.12 | | 1.15 | 1.27 | 1.21 | 1.19 | 1.15 | 1.27 | 1.21 | 1.19 | 1.14 | 1.18 | | | |
| BDL132 | 7472.4 | P | | | | | | | | | | | | | | | | | |
| BDL132 | 7472.4 | Av. | | | | | | | | | | | | | | | | | |
| BDL132 | 7473.1 | P | 0.02 | | 0.06 | | | | 0.03 | 0.13 | | | 0.03 | 0.13 | | | | | |
| BDL132 | 7473.1 | Av. | 1.12 | | 1.09 | | | | 1.31 | 1.15 | | | 1.31 | 1.15 | | | | | |
| BDL132 | 7474.4 | P | | | | | | | | | | | | | | | | | |
| BDL132 | 7474.4 | Av. | | | | | | | | | | | | | | | | | |
| BDL132 | 7471.1 | P | | | | | | | | | | | | | | | | | |
| BDL132 | 7471.1 | Av. | | | | | | | | | | | | | | | | | |
| BDL132 | 7471.4 | P | | | | | | | | | | | | | | | | | |
| BDL132 | 7471.4 | Av. | | | | | | | | | | | | | | | | | |
| BDL132 | 7472.4 | P | | | | | | | | | | | | | | | | | |
| BDL132 | 7472.4 | Av. | | | | | | | | | | | | | | | | | |
| BDL132 | 7473.1 | P | | | | | | | | | | | | | | | | | |
| BDL132 | 7473.1 | Av. | | | | | | | | | | | | | | | | | |
| BDL132 | 7475.4 | P | | | | | | | | | | | | | | | | | |
| BDL132 | 7475.4 | Av. | | | | | | | | | | | | | | | | | |
| BDL133 | 8161.1 | P | | | 0.27 | | | | | | | | | | | | | | |
| BDL133 | 8161.1 | Av. | | | 1.34 | | | | | | | | | | | | | | |
| BDL133 | 8161.2 | P | 0.07 | | 0.00 | | 0.03 | 0.01 | | 0.28 | 0.05 | | | | 0.02 | | | | 0.46 |
| BDL133 | 8161.2 | Av. | 1.29 | | 1.52 | | 1.48 | 1.16 | | 1.13 | 1.39 | | | | 1.58 | | | | 1.12 |
| BDL133 | 8161.3 | P | | | 0.06 | | | | | 0.32 | | | | 0.32 | | | | | |
| BDL133 | 8161.3 | Av. | | | 1.47 | | | | | 1.13 | | | | 1.13 | | | | | |
| BDL133 | 8161.4 | P | | | 0.15 | | | | | | | | | | | | | | |
| BDL133 | 8161.4 | Av. | | | 1.32 | | | | | | | | | | | | | | |

TABLE 25-continued

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL133 | 8162.1 | P | | | 0.07 | | | | | | | | | | | | | | |
| BDL133 | 8162.1 | Av. | | | 1.26 | | | | | | | | | | | | | | |
| BDL133 | 8162.3 | P | | | 0.03 | | | | | | | | | | 0.31 | | | | |
| BDL133 | 8162.3 | Av. | | | 1.34 | | | | | | | | | | 1.21 | | | | |
| BDL133 | 8162.5 | P | 0.30 | | 0.00 | | 0.24 | | 0.02 | 0.01 | 0.24 | | 0.02 | 0.01 | 0.17 | | | | |
| BDL133 | 8162.5 | Av. | 1.15 | | 1.53 | | 1.27 | | 1.17 | 1.22 | 1.27 | | 1.17 | 1.22 | 1.45 | | | | |
| BDL133 | 8163.2 | P | | | 0.27 | | | | | | | | | | 0.59 | | | | |
| BDL133 | 8163.2 | Av. | | | 1.33 | | | | | | | | | | 1.29 | | | | |
| BDL134 | 7671.2 | P | | | | | | | | | | | | | | | | | |
| BDL134 | 7671.2 | Av. | | | | | | | | | | | | | | | | | |
| BDL134 | 7672.1 | P | | | | | | | | | | | | | | | | | |
| BDL134 | 7672.1 | Av. | | | | | | | | | | | | | | | | | |
| BDL134 | 7673.1 | P | | | | | | | | | | | | | | | | | |
| BDL134 | 7673.1 | Av. | | | | | | | | | | | | | | | | | |
| BDL134 | 7673.2 | P | | | 0.21 | | | | | | | | | | | | | | |
| BDL134 | 7673.2 | Av. | | | 1.19 | | | | | | | | | | | | | | |
| BDL135 | 7722.1 | P | | | 0.03 | | | | | | | | | | 0.55 | | | | |
| BDL135 | 7722.1 | Av. | | | 1.35 | | | | | | | | | | 1.12 | | | | |
| BDL135 | 7723.1 | P | | | 0.01 | | | | | | | | | | | | | | |
| BDL135 | 7723.1 | Av. | | | 1.40 | | | | | | | | | | | | | | |
| BDL135 | 7723.3 | P | | | 0.27 | | | | | | | | | | | | | | |
| BDL135 | 7723.3 | Av. | | | 1.17 | | | | | | | | | | | | | | |
| BDL135 | 7723.8 | P | | | 0.11 | | | | | | | | | | | | | | |
| BDL135 | 7723.8 | Av. | | | 1.31 | | | | | | | | | | | | | | |
| BDL135 | 7723.9 | P | 0.35 | | 0.00 | | 0.36 | 0.37 | 0.03 | 0.01 | 0.36 | 0.37 | 0.03 | 0.01 | 0.24 | | | | |
| BDL135 | 7723.9 | Av. | 1.18 | | 1.57 | | 1.41 | 1.17 | 1.15 | 1.17 | 1.41 | 1.17 | 1.15 | 1.17 | 1.54 | | | | |
| BDL136 | 7751.4 | P | 0.36 | | 0.01 | | | | | | | | | | 0.55 | | | | |
| BDL136 | 7751.4 | Av. | 1.17 | | 1.39 | | | | | | | | | | 1.12 | | | | |
| BDL136 | 7751.5 | P | | | 0.25 | | | | | | | | | | | | | | |
| BDL136 | 7751.5 | Av. | | | 1.16 | | | | | | | | | | | | | | |
| BDL136 | 7751.8 | P | 0.06 | | 0.01 | 0.33 | 0.18 | 0.06 | 0.17 | 0.20 | 0.18 | 0.06 | 0.17 | 0.20 | 0.24 | 0.36 | | | 0.06 |
| BDL136 | 7751.8 | Av. | 1.31 | | 1.65 | 1.16 | 1.25 | 1.33 | 1.28 | 1.33 | 1.25 | 1.33 | 1.28 | 1.33 | 1.24 | 1.13 | | | 1.11 |
| BDL136 | 7752.6 | P | | | 0.01 | | | | | | | | | | 0.10 | | | | |
| BDL136 | 7752.6 | Av. | | | 1.44 | | | | | | | | | | 1.36 | | | | |
| BDL137 | 7701.2 | P | | | 0.00 | | | | 0.30 | 0.29 | | | 0.30 | 0.29 | | | | | |
| BDL137 | 7701.2 | Av. | | | 1.51 | | | | 1.16 | 1.13 | | | 1.16 | 1.13 | | | | | |
| BDL137 | 7701.5 | P | | | 0.09 | | | | | | | | | | | | | | |
| BDL137 | 7701.5 | Av. | | | 1.34 | | | | | | | | | | | | | | |
| BDL137 | 7701.6 | P | | | 0.06 | | | | | | | | | | 0.67 | | | | |
| BDL137 | 7701.6 | Av. | | | 1.44 | | | | | | | | | | 1.21 | | | | |
| BDL137 | 7702.1 | P | | | | | | | | | | | | | | | | | |
| BDL137 | 7702.1 | Av. | | | | | | | | | | | | | | | | | |
| BDL137 | 7703.2 | P | | | 0.06 | | | | | | | | | | | | | | |
| BDL137 | 7703.2 | Av. | | | 1.38 | | | | | | | | | | | | | | |
| BDL137 | 7703.3 | P | | | 0.16 | | | | | | | | | | | | | | |
| BDL137 | 7703.3 | Av. | | | 1.20 | | | | | | | | | | | | | | |
| BDL137 | 7703.7 | P | | | 0.13 | | | | | | | | | | 0.46 | | | | |
| BDL137 | 7703.7 | Av. | | | 1.36 | | | | | | | | | | 1.27 | | | | |
| BDL139 | 8131.1 | P | | | | | | | | | | | | | | | | | |
| BDL139 | 8131.1 | Av. | | | | | | | | | | | | | | | | | |
| BDL139 | 8131.2 | P | | | | | | | | | | | | | | | | | |
| BDL139 | 8131.2 | Av. | | | | | | | | | | | | | | | | | |
| BDL139 | 8132.7 | P | | | | | | | | | | | | | | | | | |
| BDL139 | 8132.7 | Av. | | | | | | | | | | | | | | | | | |
| BDL139 | 8133.2 | P | | | | | | | | | | | | | | | | | |
| BDL139 | 8133.2 | Av. | | | | | | | | | | | | | | | | | |
| BDL141 | 8141.2 | P | | | 0.06 | | | | | | | | | | 0.30 | | | | |
| BDL141 | 8141.2 | Av. | | | 1.39 | | | | | | | | | | 1.21 | | | | |
| BDL141 | 8142.2 | P | | | | | | | | | | | | | | | | | |
| BDL141 | 8142.2 | Av. | | | | | | | | | | | | | | | | | |
| BDL142 | 8282.1 | P | | | 0.18 | | | | | | | | | | | | | | |
| BDL142 | 8282.1 | Av. | | | 1.34 | | | | | | | | | | | | | | |
| BDL142 | 8283.1 | P | | | 0.11 | | | | | | | | | | | | | | |
| BDL142 | 8283.1 | Av. | | | 1.24 | | | | | | | | | | | | | | |
| BDL142 | 8283.2 | P | | | 0.01 | | 0.47 | | | | 0.47 | | | | 0.06 | | | | |
| BDL142 | 8283.2 | Av. | | | 1.45 | | 1.18 | | | | 1.18 | | | | 1.42 | | | | |
| BDL142 | 8284.1 | P | | | 0.02 | | | | | | | | | | | | | | |
| BDL142 | 8284.1 | Av. | | | 1.36 | | | | | | | | | | | | | | |
| BDL142 | 8285.3 | P | | | 0.13 | | | | | | | | | | | | | | |
| BDL142 | 8285.3 | Av. | | | 1.23 | | | | | | | | | | | | | | |
| BDL142 | 8285.5 | P | 0.49 | | 0.06 | | 0.51 | 0.57 | | | 0.51 | 0.57 | | | 0.24 | | | | |
| BDL142 | 8285.5 | Av. | 1.10 | | 1.53 | | 1.12 | 1.11 | | | 1.12 | 1.11 | | | 1.24 | | | | |
| BDL143 | 8411.1 | P | 0.33 | | 0.00 | | 0.28 | 0.03 | 0.00 | 0.06 | 0.28 | 0.03 | 0.00 | 0.06 | 0.30 | 0.08 | | | 0.03 |
| BDL143 | 8411.1 | Av. | 1.18 | | 1.73 | | 1.47 | 1.36 | 1.28 | 1.32 | 1.47 | 1.36 | 1.28 | 1.32 | 1.51 | 1.12 | | | 1.17 |
| BDL143 | 8411.5 | P | 0.37 | | 0.04 | | | | | | | | | | 0.64 | | | | |
| BDL143 | 8411.5 | Av. | 1.13 | | 1.37 | | | | | | | | | | 1.12 | | | | |
| BDL143 | 8412.2 | P | | | 0.24 | | | | | | | | | | | | | | |
| BDL143 | 8412.2 | Av. | | | 1.20 | | | | | | | | | | | | | | |

TABLE 25-continued

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL143 | 8412.4 | P | | | | | | | | | | | | | | | | | |
| BDL143 | 8412.4 | Av. | | | | | | | | | | | | | | | | | |
| BDL143 | 8413.3 | P | | | 0.21 | | | | | | | | | | | | | | |
| BDL143 | 8413.3 | Av. | | | 1.18 | | | | | | | | | | | | | | |
| BDL143 | 8414.4 | P | | | 0.35 | | | | | | | | | | | | | | |
| BDL143 | 8414.4 | Av. | | | 1.35 | | | | | | | | | | | | | | |
| BDL143 | 8414.5 | P | | | 0.19 | | | | | | | | | | | | | | |
| BDL143 | 8414.5 | Av. | | | 1.19 | | | | | | | | | | | | | | |
| BDL144 | 8384.1 | P | | | 0.05 | | | | | | | | | | | | | | |
| BDL144 | 8384.1 | Av. | | | 1.30 | | | | | | | | | | | | | | |
| BDL144 | 8384.5 | P | | | 0.06 | | | | | | | | | | | | | | |
| BDL144 | 8384.5 | Av. | | | 1.29 | | | | | | | | | | | | | | |
| BDL144 | 8385.1 | P | | | | | | | | | | | | | | | | | |
| BDL144 | 8385.1 | Av. | | | | | | | | | | | | | | | | | |
| BDL145 | 8233.2 | P | | | 0.10 | | | | | | | | | | | | | | |
| BDL145 | 8233.2 | Av. | | | 1.26 | | | | | | | | | | | | | | |
| BDL145 | 8233.3 | P | | | | | | | | | | | | | | | | | |
| BDL145 | 8233.3 | Av. | | | | | | | | | | | | | | | | | |
| BDL145 | 8235.1 | P | | | 0.13 | | | | | | | | | | | | | | |
| BDL145 | 8235.1 | Av. | | | 1.24 | | | | | | | | | | | | | | |
| BDL145 | 8235.3 | P | | | | | | | | | | | | | | | | | |
| BDL145 | 8235.3 | Av. | | | | | | | | | | | | | | | | | |
| BDL145 | 8235.4 | P | | | | | | | | | | | | | | | | | |
| BDL145 | 8235.4 | Av. | | | | | | | | | | | | | | | | | |
| BDL146 | 8241.1 | P | 0.42 | | 0.13 | | 0.32 | | 0.60 | | 0.32 | | 0.60 | | 0.15 | | | | |
| BDL146 | 8241.1 | Av. | 1.12 | | 1.46 | | 1.18 | | 1.13 | | 1.18 | | 1.13 | | 1.30 | | | | |
| BDL146 | 8241.3 | P | | | 0.08 | | | | | | | | | | | | | | |
| BDL146 | 8241.3 | Av. | | | 1.28 | | | | | | | | | | | | | | |
| BDL146 | 8243.2 | P | | | 0.06 | | | | | | | | | | 0.55 | | | | |
| BDL146 | 8243.2 | Av. | | | 1.37 | | | | | | | | | | 1.12 | | | | |
| BDL146 | 8243.5 | P | | | 0.45 | | | | | | | | | | | | | | |
| BDL146 | 8243.5 | Av. | | | 1.21 | | | | | | | | | | | | | | |
| BDL146 | 8244.4 | P | | | 0.07 | | | 0.33 | 0.27 | 0.42 | | 0.33 | 0.27 | 0.42 | | | 0.21 | | |
| BDL146 | 8244.4 | Av. | | | 1.57 | | | 1.16 | 1.26 | 1.22 | | 1.16 | 1.26 | 1.22 | | | 1.11 | | |
| BDL146 | 8244.7 | P | | | 0.47 | | | | | | | | | | | | | | |
| BDL146 | 8244.7 | Av. | | | 1.10 | | | | | | | | | | | | | | |
| BDL146 | 8245.2 | P | | | 0.02 | | | | | | | | | | | | | | |
| BDL146 | 8245.2 | Av. | | | 1.35 | | | | | | | | | | | | | | |
| BDL146 | 8245.5 | P | 0.32 | | 0.00 | | 0.23 | | 0.21 | 0.47 | 0.23 | | 0.21 | 0.47 | 0.05 | | | | |
| BDL146 | 8245.5 | Av. | 1.16 | | 1.51 | | 1.21 | | 1.13 | 1.11 | 1.21 | | 1.13 | 1.11 | 1.45 | | | | |
| BDL42 | 7771.1 | P | | | | | | | | | | | | | | | | | |
| BDL42 | 7771.1 | Av. | | | | | | | | | | | | | | | | | |
| BDL42 | 7772.1 | P | | | | | | | | | | | | | | | | | |
| BDL42 | 7772.1 | Av. | | | | | | | | | | | | | | | | | |
| BDL42 | 7772.7 | P | | | | | | | | | | | | | | | | | |
| BDL42 | 7772.7 | Av. | | | | | | | | | | | | | | | | | |
| BDL42 | 7774.1 | P | | | | | | | | | | | | | | | | | |
| BDL42 | 7774.1 | Av. | | | | | | | | | | | | | | | | | |
| BDL42 | 7774.2 | P | | | | | | | | | | | | | | | | | |
| BDL42 | 7774.2 | Av. | | | | | | | | | | | | | | | | | |
| BDL42 | 7774.4 | P | | | 0.56 | | | | | | | | | | | | | | |
| BDL42 | 7774.4 | Av. | | | 1.11 | | | | | | | | | | | | | | |
| BDL46 | 7833.3 | P | | | | | | | | | | | | | | | | | |
| BDL46 | 7833.3 | Av. | | | | | | | | | | | | | | | | | |
| BDL46 | 7833.4 | P | 0.27 | | | | | | | | | | | | | | 0.10 | | |
| BDL46 | 7833.4 | Av. | 1.10 | | | | | | | | | | | | | | 1.08 | | |
| BDL46 | 7833.5 | P | | | | | | | | | | | | | | | | | |
| BDL46 | 7833.5 | Av. | | | | | | | | | | | | | | | | | |
| BDL46 | 7833.6 | P | | | | | | | | | | | | | | | | | |
| BDL46 | 7833.6 | Av. | | | | | | | | | | | | | | | | | |
| BDL46 | 7834.1 | P | | | | | | | | | | | | | | | | | |
| BDL46 | 7834.1 | Av. | | | | | | | | | | | | | | | | | |
| BDL46 | 7833.1 | P | | | | | | | | | | | | | | | | | |
| BDL46 | 7833.1 | Av. | | | | | | | | | | | | | | | | | |
| BDL46 | 7833.3 | P | | | | | | | | | | | | | | | | | |
| BDL46 | 7833.3 | Av. | | | | | | | | | | | | | | | | | |
| BDL46 | 7833.4 | P | | | | | | | | | | | | | | | | | |
| BDL46 | 7833.4 | Av. | | | | | | | | | | | | | | | | | |
| BDL46 | 7833.5 | P | | | | | | | | | | | | | | | | | |
| BDL46 | 7833.5 | Av. | | | | | | | | | | | | | | | | | |
| BDL46 | 7834.4 | P | | | | | | | | | | | | | | | | | 0.19 |
| BDL46 | 7834.4 | Av. | | | | | | | | | | | | | | | | | 1.25 |
| BDL51 | 7291.1 | P | | | | | | | | | | | | | | | | | |
| BDL51 | 7291.1 | Av. | | | | | | | | | | | | | | | | | |
| BDL51 | 8021.1 | P | | | | | | | | | | | | | | | | | |
| BDL51 | 8021.1 | Av. | | | | | | | | | | | | | | | | | |
| BDL51 | 8022.4 | P | | | | | | | | | | | | | | | | | |
| BDL51 | 8022.4 | Av. | | | | | | | | | | | | | | | | | |

TABLE 25-continued

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL51 | 8022.5 | P | | | | | | | | | | | | | | | | | |
| BDL51 | 8022.5 | Av. | | | | | | | | | | | | | | | | | |
| BDL51 | 8024.4 | P | | | | | | | | | | | | | | | | | |
| BDL51 | 8024.4 | Av. | | | | | | | | | | | | | | | | | |
| BDL51 | 8024.7 | P | | | | | | | | | | | | | | | | | |
| BDL51 | 8024.7 | Av. | | | | | | | | | | | | | | | | | |
| BDL52 | 7861.1 | P | | | | | | | | | | | | | | | | 0.02 | |
| BDL52 | 7861.1 | Av. | | | | | | | | | | | | | | | | 1.08 | |
| BDL52 | 7861.5 | P | | | | | | | | | | | | | | | | | |
| BDL52 | 7861.5 | Av. | | | | | | | | | | | | | | | | | |
| BDL52 | 7863.2 | P | | | | | | | | | | | | | 0.17 | | | | |
| BDL52 | 7863.2 | Av. | | | | | | | | | | | | | 1.12 | | | | |
| BDL52 | 7864.5 | P | | | | | | | 0.14 | 0.14 | | | 0.14 | 0.14 | | | | | |
| BDL52 | 7864.5 | Av. | | | | | | | 1.16 | 1.12 | | | 1.16 | 1.12 | | | | | |
| BDL54 | 7781.1 | P | | | | | | | | | | | | | | | | | |
| BDL54 | 7781.1 | Av. | | | | | | | | | | | | | | | | | |
| BDL54 | 7781.4 | P | | | | | | | | | | | | | | | | | |
| BDL54 | 7781.4 | Av. | | | | | | | | | | | | | | | | | |
| BDL54 | 7784.3 | P | | | | | | | | | | | | | | | | | |
| BDL54 | 7784.3 | Av. | | | | | | | | | | | | | | | | | |
| BDL54 | 7784.5 | P | | | | | | | | | | | | | | | | | |
| BDL54 | 7784.5 | Av. | | | | | | | | | | | | | | | | | |
| BDL54 | 7785.4 | P | | | | | | | | | | | | | | | | | |
| BDL54 | 7785.4 | Av. | | | | | | | | | | | | | | | | | |
| BDL54 | 7781.1 | P | | | | | | | | | | | | | | | | | |
| BDL54 | 7781.1 | Av. | | | | | | | | | | | | | | | | | |
| BDL54 | 7781.4 | P | | | | | | | | | | | | | | | | | |
| BDL54 | 7781.4 | Av. | | | | | | | | | | | | | | | | | |
| BDL54 | 7784.3 | P | | | | | | | | | | | | | | | | | |
| BDL54 | 7784.3 | Av. | | | | | | | | | | | | | | | | | |
| BDL54 | 7785.4 | P | | | | | | | | | | | | | | | | | |
| BDL54 | 7785.4 | Av. | | | | | | | | | | | | | | | | | |
| BDL54 | 7785.8 | P | | | | | | | | | | | | | | | | | |
| BDL54 | 7785.8 | Av. | | | | | | | | | | | | | | | | | |
| BDL56 | 7181.2 | P | | | | | | | | | | | | | | | | | |
| BDL56 | 7181.2 | Av. | | | | | | | | | | | | | | | | | |
| BDL56 | 8301.1 | P | 0.00 | 0.05 | 0.04 | 0.04 | 0.31 | 0.00 | 0.02 | 0.02 | 0.31 | 0.00 | 0.02 | 0.02 | 0.38 | 0.07 | 0.02 | | 0.28 |
| BDL56 | 8301.1 | Av. | 1.26 | 1.18 | 1.21 | 1.12 | 1.36 | 1.33 | 1.33 | 1.33 | 1.36 | 1.33 | 1.33 | 1.33 | 1.16 | 1.09 | 1.09 | | 1.32 |
| BDL56 | 8301.3 | P | | | | | | | | | | | | | | | | | |
| BDL56 | 8301.3 | Av. | | | | | | | | | | | | | | | | | |
| BDL56 | 8304.1 | P | 0.14 | | 0.04 | | 0.45 | | 0.09 | 0.06 | 0.45 | | 0.09 | 0.06 | 0.58 | | 0.06 | 0.17 | 0.39 |
| BDL56 | 8304.1 | Av. | 1.19 | | 1.11 | | 1.28 | | 1.17 | 1.16 | 1.28 | | 1.17 | 1.16 | 1.14 | | 1.09 | 1.12 | 1.23 |
| BDL56 | 8305.1 | P | | | | | | | | | | | | | | | | | |
| BDL56 | 8305.1 | Av. | | | | | | | | | | | | | | | | | |
| BDL56 | 8301.1 | P | | | | | | | | | | | | | | | | | |
| BDL56 | 8301.1 | Av. | | | | | | | | | | | | | | | | | |
| BDL56 | 8301.2 | P | | | | | | | | | | | | | | | | | 0.39 |
| BDL56 | 8301.2 | Av. | | | | | | | | | | | | | | | | | 1.24 |
| BDL56 | 8301.3 | P | | | | | | | | | | | | | | | | | |
| BDL56 | 8301.3 | Av. | | | | | | | | | | | | | | | | | |
| BDL56 | 8303.1 | P | | | | | | | | | | | | | | | | | 0.43 |
| BDL56 | 8303.1 | Av. | | | | | | | | | | | | | | | | | 1.11 |
| BDL56 | 8303.2 | P | | | | | | | | | | | | | | | | | |
| BDL56 | 8303.2 | Av. | | | | | | | | | | | | | | | | | |
| BDL59 | 7792.1 | P | 0.00 | 0.05 | | 0.14 | 0.23 | 0.06 | | 0.04 | 0.23 | 0.06 | | 0.04 | 0.08 | 0.00 | | 0.06 | 0.09 |
| BDL59 | 7792.1 | Av. | 1.21 | 1.15 | | 1.10 | 1.25 | 1.24 | | 1.24 | 1.25 | 1.24 | | 1.24 | 1.16 | 1.17 | | 1.13 | 1.16 |
| BDL59 | 7792.2 | P | | | | | | | | | | | | | | | 0.05 | 0.20 | |
| BDL59 | 7792.2 | Av. | | | | | | | | | | | | | | | 1.09 | 1.12 | |
| BDL59 | 7792.3 | P | 0.21 | 0.16 | 0.03 | 0.05 | 0.57 | 0.03 | 0.12 | 0.10 | 0.57 | 0.03 | 0.12 | 0.10 | 0.58 | 0.07 | 0.09 | 0.00 | 0.62 |
| BDL59 | 7792.3 | Av. | 1.12 | 1.13 | 1.17 | 1.11 | 1.22 | 1.23 | 1.18 | 1.13 | 1.22 | 1.23 | 1.18 | 1.13 | 1.14 | 1.09 | 1.12 | 1.20 | 1.13 |
| BDL59 | 7793.3 | P | | | | | | | | | | | | | | | 0.07 | 0.09 | |
| BDL59 | 7793.3 | Av. | | | | | | | | | | | | | | | 1.05 | 1.07 | |
| BDL59 | 7794.1 | P | | | | | | | | | | | | | | | | | |
| BDL59 | 7794.1 | Av. | | | | | | | | | | | | | | | | | |
| BDL60 | 8011.4 | P | | | | | | 0.47 | 0.40 | 0.42 | | 0.47 | 0.40 | 0.42 | | | 0.27 | 0.00 | |
| BDL60 | 8011.4 | Av. | | | | | | 1.18 | 1.21 | 1.19 | | 1.18 | 1.21 | 1.19 | | | 1.11 | 1.11 | |
| BDL60 | 8011.7 | P | | | | | | | | | | | | | | | | | |
| BDL60 | 8011.7 | Av. | | | | | | | | | | | | | | | | | |
| BDL60 | 8013.4 | P | | | | | | | | | | | | | | | | | |
| BDL60 | 8013.4 | Av. | | | | | | | | | | | | | | | | | |
| BDL60 | 8013.6 | P | | | | | | | | | | | | | | | | | |
| BDL60 | 8013.6 | Av. | | | | | | | | | | | | | | | | | |
| BDL60 | 8014.5 | P | | | | | | | | | | | | | | | | | |
| BDL60 | 8014.5 | Av. | | | | | | | | | | | | | | | | | |
| BDL60 | 8013.6 | P | | | | | | | | | | | | | | | | | |
| BDL60 | 8013.6 | Av. | | | | | | | | | | | | | | | | | |
| BDL60 | 8014.2 | P | | | | | | | | | | | | | | | | | 0.00 |
| BDL60 | 8014.2 | Av. | | | | | | | | | | | | | | | | | 1.20 |

TABLE 25-continued

| Gene | Ev. | Par. | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|---|
| BDL60 | 8014.7 | P | | | | | | | | | | | | | | | | | 0.48 |
| BDL60 | 8014.7 | Av. | | | | | | | | | | | | | | | | | 1.27 |
| BDL60 | 8014.8 | P | | | | | | | | | | | | | | | | | |
| BDL60 | 8014.8 | Av. | | | | | | | | | | | | | | | | | |
| BDL65 | 7824.1 | P | | | | | | | | | | | | | | | | | |
| BDL65 | 7824.1 | Av. | | | | | | | | | | | | | | | | | |
| BDL65 | 7825.2 | P | | | | | | | | | | | | | 0.36 | | | | |
| BDL65 | 7825.2 | Av. | | | | | | | | | | | | | 1.27 | | | | |
| BDL65 | 8473.2 | P | | | | | | | | | | | | | | | | | |
| BDL65 | 8473.2 | Av. | | | | | | | | | | | | | | | | | |
| BDL65 | 8474.1 | P | | | 0.03 | | 0.50 | | | | 0.50 | | | | 0.30 | | | | |
| BDL65 | 8474.1 | Av. | | | 1.32 | | 1.14 | | | | 1.14 | | | | 1.36 | | | | |
| BDL67 | 7901.5 | P | | | | | | | | | | | | | | | | | |
| BDL67 | 7901.5 | Av. | | | | | | | | | | | | | | | | | |
| BDL67 | 7902.3 | P | | | | | | | | | | | | | | | | | |
| BDL67 | 7902.3 | Av. | | | | | | | | | | | | | | | | | |
| BDL67 | 7902.7 | P | | | | | | | | | | | | | | | | | |
| BDL67 | 7902.7 | Av. | | | | | | | | | | | | | | | | | |
| BDL67 | 7903.3 | P | | | | | | | | | | | | | | | | | |
| BDL67 | 7903.3 | Av. | | | | | | | | | | | | | | | | | |
| BDL67 | 7903.5 | P | | | | | | | | | | | | | | | | | |
| BDL67 | 7903.5 | Av. | | | | | | | | | | | | | | | | | |
| BDL68 | 7761.3 | P | | | | | | | | | | | | | | | | | |
| BDL68 | 7761.3 | Av. | | | | | | | | | | | | | | | | | |
| BDL68 | 7761.8 | P | | | | | | | | | | | | | | | | | |
| BDL68 | 7761.8 | Av. | | | | | | | | | | | | | | | | | |
| BDL68 | 7761.9 | P | | | | | | | | | | | | | | | | | |
| BDL68 | 7761.9 | Av. | | | | | | | | | | | | | | | | | |
| BDL68 | 7763.2 | P | | | | | | | | | | | | | | | | | |
| BDL68 | 7763.2 | Av. | | | | | | | | | | | | | | | | | |
| BDL68 | 7764.1 | P | | | | | | | | | | | | | | | | | |
| BDL68 | 7764.1 | Av. | | | | | | | | | | | | | | | | | |
| BDL78 | 7911.11 | P | | | 0.03 | | | | | | | | | | 0.55 | | | | |
| BDL78 | 7911.11 | Av. | | | 1.34 | | | | | | | | | | 1.12 | | | | |
| BDL78 | 7911.8 | P | | | 0.31 | | | | | | | | | | | | | | |
| BDL78 | 7911.8 | Av. | | | 1.20 | | | | | | | | | | | | | | |
| BDL78 | 7911.9 | P | | | | | | | | | | | | | | | | | |
| BDL78 | 7911.9 | Av. | | | | | | | | | | | | | | | | | |
| BDL78 | 7912.6 | P | | | 0.11 | | | | | | | | | | | | | | |
| BDL78 | 7912.6 | Av. | | | 1.23 | | | | | | | | | | | | | | |
| BDL78 | 7913.11 | P | | | 0.48 | | | | | | | | | | | | | | |
| BDL78 | 7913.11 | Av. | | | 1.11 | | | | | | | | | | | | | | |
| BDL78 | 7913.3 | P | | | 0.00 | | 0.47 | | | | 0.47 | | | | 0.19 | | | | |
| BDL78 | 7913.3 | Av. | | | 1.46 | | 1.13 | | | | 1.13 | | | | 1.33 | | | | |
| BDL78 | 7913.6 | P | | | | | | | | | | | | | | | | | |
| BDL78 | 7913.6 | Av. | | | | | | | | | | | | | | | | | |
| BDL78 | 7913.8 | P | | | 0.39 | | | | | | | | | | | | | | |
| BDL78 | 7913.8 | Av. | | | 1.12 | | | | | | | | | | | | | | |
| BDL78 | 7913.9 | P | | | 0.01 | | | | | | | | | | | | | | |
| BDL78 | 7913.9 | Av. | | | 1.38 | | | | | | | | | | | | | | |
| BDL82 | 7801.1 | P | | | | | | | | | | | | | | | | | |
| BDL82 | 7801.1 | Av. | | | | | | | | | | | | | | | | | |
| BDL82 | 7801.3 | P | | | | | | | | | | | | | | | | | |
| BDL82 | 7801.3 | Av. | | | | | | | | | | | | | | | | | |
| BDL82 | 7802.2 | P | | | | | | | | | | | | | | | | | |
| BDL82 | 7802.2 | Av. | | | | | | | | | | | | | | | | | |
| BDL82 | 7802.3 | P | | | | | | | | | | | | | | | | | |
| BDL82 | 7802.3 | Av. | | | | | | | | | | | | | | | | | |
| BDL82 | 7803.9 | P | 0.14 | 0.02 | 0.01 | 0.02 | 0.00 | 0.13 | 0.01 | 0.08 | 0.00 | 0.13 | 0.01 | 0.08 | 0.01 | 0.02 | 0.00 | 0.12 | 0.00 |
| BDL82 | 7803.9 | Av. | 1.29 | 1.13 | 1.16 | 1.14 | 1.48 | 1.25 | 1.38 | 1.30 | 1.48 | 1.25 | 1.38 | 1.30 | 1.26 | 1.14 | 1.11 | 1.12 | 1.34 |
| BDL89 | 7812.2 | P | | | | | | | | | | | | | | | | 0.07 | |
| BDL89 | 7812.2 | Av. | | | | | | | | | | | | | | | | 1.05 | |
| BDL89 | 7812.5 | P | | | | | | | | | | | | | | | | | |
| BDL89 | 7812.5 | Av. | | | | | | | | | | | | | | | | | |
| BDL89 | 7814.1 | P | 0.19 | | | | | | | | | | | | | | | | |
| BDL89 | 7814.1 | Av. | 1.20 | | | | | | | | | | | | | | | | |
| BDL89 | 7814.4 | P | | | | | | | | | | | | | | | | | |
| BDL89 | 7814.4 | Av. | | | | | | | | | | | | | | | | | |
| BDL89 | 7814.5 | P | | | | | | | | | | | | | | | | | |
| BDL89 | 7814.5 | Av. | | | | | | | | | | | | | | | | | |

Table 25.
"P" = P-value;
"Av" = ratio between the averages of event and control. Note that when the average ratio is higher than "1" the effect of exogenous expression of the gene is an increase of the desired trait;
"Par" = Parameter according to the parameters listed in Table 24 above;
"Ev" = event.

TABLE 26

| Gene | Ev. | Par. | 18 | 19 | 20 | 21 | 22 | 23 | 24 | 25 | 26 | 27 | 28 | 29 | 30 | 31 | 32 | 33 | 34 |
|---|---|---|---|---|---|---|---|---|---|---|---|---|---|---|---|---|---|---|---|
| BDL95 | 7841.5 | P | | | | 0.71 | | | 0.78 | | | | | 0.70 | | | 0.66 | | |
| BDL95 | 7841.5 | Av. | | | | 1.23 | | | 1.18 | | | | | 1.19 | | | 1.31 | | |
| BDL95 | 7842.12 | P | | | | 0.67 | | 0.75 | 0.19 | | | | | | | 0.70 | 0.32 | | |
| BDL95 | 7842.12 | Av. | | | | 1.11 | | 1.18 | 2.66 | | | | | | | 1.28 | 2.84 | | |
| BDL95 | 7842.2 | P | | | | 0.78 | | | 0.47 | | | | | | | | 0.41 | | |
| BDL95 | 7842.2 | Av. | | | | 1.11 | | | 55.83 | | | | | | | | 28.99 | | |
| BDL95 | 7842.8 | P | | | | | 0.56 | 0.56 | 0.46 | | | | | | 0.35 | 0.41 | 0.46 | | |
| BDL95 | 7842.8 | Av. | | | | | 1.36 | 1.29 | 3.76 | | | | | | 1.56 | 1.57 | 4.32 | | |
| BDL95 | 7843.4 | P | | | | 0.03 | 0.56 | | 0.54 | | | | | 0.00 | 0.53 | 0.16 | 0.48 | | 0.54 |
| BDL95 | 7843.4 | Av. | | | | 2.00 | 2.47 | | 1.84 | | | | | 1.84 | 2.94 | 1.23 | 2.18 | | 2.06 |
| BDL100 | 7871.2 | P | | | | | | | | | | | | 0.72 | | | | 0.47 | |
| BDL100 | 7871.2 | Av. | | | | | | | | | | | | 1.17 | | | | 1.28 | |
| BDL100 | 7872.2 | P | | | | 0.00 | | | 0.82 | | | | | 0.00 | 0.13 | 0.75 | 0.57 | | 0.36 |
| BDL100 | 7872.2 | Av. | | | | 1.63 | | | 1.13 | | | | | 1.53 | 1.18 | 1.18 | 1.35 | | 1.11 |
| BDL100 | 7872.3 | P | 0.47 | | 0.39 | | | | 0.76 | 0.24 | | | | | | | 0.76 | | |
| BDL100 | 7872.3 | Av. | 1.26 | | 1.11 | | | | 2.13 | 1.10 | | | | | | | 2.04 | | |
| BDL100 | 7873.3 | P | | | | | | 0.24 | 0.19 | | | | | | | 0.22 | 0.15 | | 0.59 |
| BDL100 | 7873.3 | Av. | | | | | | 1.13 | 6.24 | | | | | | | 1.17 | 5.93 | | 1.16 |
| BDL100 | 7873.4 | P | | 0.33 | | | 0.54 | | 0.55 | | | | | | 0.55 | | 0.57 | | 0.31 |
| BDL100 | 7873.4 | Av. | | 1.17 | | | 1.87 | | 2.80 | | | | | | 2.06 | | 2.78 | | 2.02 |
| BDL106 | 7881.1 | P | | | | 0.03 | | | 0.57 | | | | | 0.03 | | | 0.60 | 0.00 | |
| BDL106 | 7881.1 | Av. | | | | 1.21 | | | 1.33 | | | | | 1.21 | | | 1.34 | 1.32 | |
| BDL106 | 7881.4 | P | | | | 0.44 | | 0.63 | 0.35 | | | | | 0.27 | 0.27 | 0.21 | 0.01 | | 0.34 |
| BDL106 | 7881.4 | Av. | | | | 5.50 | | 1.25 | 1.74 | | | | | 2.42 | 1.63 | 1.81 | 3.39 | | 1.20 |
| BDL106 | 7882.6 | P | | | | 0.48 | | | 0.31 | | | | | 0.61 | 0.70 | | 0.27 | | 0.06 |
| BDL106 | 7882.6 | Av. | | | | 1.37 | | | 1.61 | | | | | 1.35 | 1.14 | | 1.98 | | 1.49 |
| BDL106 | 7884.1 | P | | | | 0.22 | 0.46 | 0.65 | | | | | | 0.31 | 0.47 | 0.00 | | | 0.60 |
| BDL106 | 7884.1 | Av. | | | | 1.87 | 2.65 | 1.11 | | | | | | 1.67 | 3.05 | 1.34 | | | 1.56 |
| BDL106 | 7884.9 | P | | | | 0.50 | 0.41 | 0.67 | 0.22 | | | | | 0.48 | 0.38 | 0.57 | 0.05 | | 0.44 |
| BDL106 | 7884.9 | Av. | | | | 2.57 | 1.15 | 1.20 | 1.76 | | | | | 1.86 | 1.47 | 1.56 | 2.59 | | 1.13 |
| BDL106 | 7881.1 | P | | | | 0.59 | 0.66 | | 0.47 | | | | | 0.58 | 0.61 | 0.23 | 0.38 | | |
| BDL106 | 7881.1 | Av. | | | | 4.09 | 1.25 | | 1.56 | | | | | 4.38 | 1.29 | 1.32 | 1.69 | | |
| BDL106 | 7881.2 | P | 0.22 | | | 0.01 | | | 0.30 | | | | | 0.17 | | | 0.22 | 0.58 | |
| BDL106 | 7881.2 | Av. | 1.16 | | | 5.82 | | | 1.38 | | | | | 6.35 | | | 1.42 | 2.85 | |
| BDL106 | 7882.2 | P | 0.10 | | | 0.57 | | 0.46 | 0.59 | | 0.03 | | | 0.65 | | 0.54 | 0.66 | 0.15 | |
| BDL106 | 7882.2 | Av. | 1.32 | | | 1.75 | | 1.84 | 1.58 | | 1.05 | | | 1.55 | | 1.82 | 1.64 | 1.68 | |
| BDL106 | 7882.4 | P | | | | | | 0.77 | 0.60 | | | | | | 0.67 | 0.66 | 0.46 | | |
| BDL106 | 7882.4 | Av. | | | | | | 1.23 | 1.49 | | | | | | 1.13 | 1.42 | 1.71 | | |
| BDL106 | 7882.5 | P | | | | | | | 0.21 | | | | | | | 0.75 | 0.21 | 0.84 | |
| BDL106 | 7882.5 | Av. | | | | | | | 1.53 | | | | | | | 1.19 | 1.58 | 1.19 | |
| BDL108 | 8122.2 | P | | | | 0.08 | 0.39 | | | | | | | 0.17 | 0.30 | 0.48 | | | 0.45 |
| BDL108 | 8122.2 | Av. | | | | 2.85 | 1.94 | | | | | | | 2.11 | 3.00 | 1.38 | | | 2.73 |
| BDL108 | 8122.3 | P | | | | 0.46 | | 0.00 | | | | | | 0.50 | 0.08 | 0.04 | | | 0.09 |
| BDL108 | 8122.3 | Av. | | | | 2.61 | | 1.46 | | | | | | 1.58 | 1.20 | 1.50 | | | 1.18 |
| BDL108 | 8123.1 | P | | | | 0.20 | | | | | | | | 0.00 | | 0.22 | | 0.41 | |
| BDL108 | 8123.1 | Av. | | | | 1.96 | | | | | | | | 1.91 | | 1.21 | | 1.59 | |
| BDL108 | 8123.2 | P | | | | 0.30 | 0.42 | | | | | | | 0.20 | 0.38 | 0.62 | | | 0.53 |
| BDL108 | 8123.2 | Av. | | | | 3.17 | 3.64 | | | | | | | 2.36 | 4.07 | 1.26 | | | 2.81 |
| BDL108 | 8123.5 | P | | | | 0.42 | 0.31 | 0.27 | 0.04 | | | | | 0.36 | 0.35 | 0.31 | 0.14 | | |
| BDL108 | 8123.5 | Av. | | | | 2.96 | 1.12 | 1.42 | 3.68 | | | | | 1.86 | 1.38 | 1.68 | 4.42 | | |
| BDL108 | 8121.1 | P | | | | 0.12 | 0.63 | 0.26 | 0.73 | | | | | 0.10 | 0.51 | 0.00 | 0.18 | 0.64 | |
| BDL108 | 8121.1 | Av. | | | | 4.75 | 1.33 | 1.54 | 1.19 | | | | | 6.16 | 1.59 | 2.33 | 2.15 | 1.28 | |
| BDL108 | 8121.3 | P | | | | 0.65 | 0.35 | 0.44 | | | | | | 0.68 | 0.62 | 0.35 | 0.50 | | |
| BDL108 | 8121.3 | Av. | | | | 2.11 | 1.24 | 1.36 | | | | | | 1.88 | 1.12 | 1.61 | 1.34 | | |
| BDL108 | 8121.4 | P | | | | 0.44 | 0.48 | | | | | | | 0.44 | 0.13 | 0.14 | 0.74 | | |
| BDL108 | 8121.4 | Av. | | | | 2.83 | 1.17 | | | | | | | 3.66 | 1.46 | 1.32 | 1.14 | | |
| BDL108 | 8122.7 | P | | | | 0.67 | | | 0.28 | | | | | 0.63 | 0.84 | 0.30 | 0.05 | 0.85 | |
| BDL108 | 8122.7 | Av. | | | | 4.00 | | | 1.52 | | | | | 5.66 | 1.22 | 1.64 | 2.58 | 1.56 | |
| BDL108 | 8123.7 | P | | | | 0.71 | 0.38 | 0.06 | 0.32 | | | | | 0.72 | 0.23 | 0.00 | 0.08 | | |
| BDL108 | 8123.7 | Av. | | | | 2.15 | 1.54 | 1.18 | 1.32 | | | | | 2.11 | 1.77 | 1.48 | 1.67 | | |
| BDL110 | 8092.1 | P | | | | | | | | | | | | | | | | 0.00 | |
| BDL110 | 8092.1 | Av. | | | | | | | | | | | | | | | | 1.28 | |
| BDL110 | 8092.2 | P | | | | | 0.52 | 0.24 | 0.44 | | | | | 0.22 | 0.37 | 0.26 | 0.45 | 0.27 | |
| BDL110 | 8092.2 | Av. | | | | | 1.35 | 1.76 | 1.62 | | | | | 1.14 | 1.48 | 1.96 | 1.92 | 1.22 | |
| BDL110 | 8092.5 | P | 0.23 | 0.01 | 0.01 | | | | 0.37 | | | | | | | | | 0.09 | |
| BDL110 | 8092.5 | Av. | 1.16 | 1.15 | 1.17 | | | | 1.28 | | | | | | | | | 1.32 | |
| BDL110 | 8095.2 | P | | | | | | | | | | | | | | | | 0.00 | |
| BDL110 | 8095.2 | Av. | | | | | | | | | | | | | | | | 1.24 | |
| BDL111 | 8102.7 | P | | | | 0.00 | 0.25 | | | | | | | 0.01 | 0.02 | 0.30 | | | 0.25 |
| BDL111 | 8102.7 | Av. | | | | 1.62 | 1.11 | | | | | | | 1.57 | 1.42 | 1.12 | | | 1.26 |
| BDL111 | 8103.1 | P | | | | 0.41 | 0.06 | 0.08 | 0.32 | | | | | 0.36 | 0.29 | 0.30 | 0.12 | | 0.32 |
| BDL111 | 8103.1 | Av. | | | | 2.15 | 1.27 | 1.11 | 2.44 | | | | | 1.85 | 1.76 | 1.40 | 3.38 | | 1.37 |
| BDL111 | 8103.2 | P | | | | 0.00 | | | | | | | | 0.00 | 0.13 | | | | |
| BDL111 | 8103.2 | Av. | | | | 1.79 | | | | | | | | 1.66 | 1.20 | | | | |
| BDL111 | 8103.4 | P | | | | 0.41 | 0.12 | 0.00 | 0.50 | | | | | 0.28 | 0.22 | 0.00 | 0.40 | | |
| BDL111 | 8103.4 | Av. | | | | 1.87 | 1.44 | 1.52 | 2.06 | | | | | 1.58 | 1.72 | 1.87 | 2.83 | | |
| BDL111 | 8103.5 | P | | | | 0.06 | 0.71 | 0.34 | 0.00 | | | | | 0.12 | 0.35 | 0.18 | 0.00 | 0.73 | |
| BDL111 | 8103.5 | Av. | | | | 1.77 | 1.11 | 1.21 | 4.29 | | | | | 1.66 | 1.25 | 1.37 | 5.17 | 1.14 | |

TABLE 26-continued

| Gene | Ev. | Par. | 18 | 19 | 20 | 21 | 22 | 23 | 24 | 25 | 26 | 27 | 28 | 29 | 30 | 31 | 32 | 33 | 34 |
|---|---|---|---|---|---|---|---|---|---|---|---|---|---|---|---|---|---|---|---|
| BDL111 | 8102.7 | P | | | | 0.46 | 0.20 | 0.63 | 0.13 | | | | | 0.44 | 0.28 | 0.34 | 0.06 | | |
| BDL111 | 8102.7 | Av. | | | | 2.95 | 1.35 | 1.15 | 1.51 | | | | | 3.43 | 1.57 | 1.37 | 1.68 | | |
| BDL111 | 8103.1 | P | 0.57 | 0.65 | 0.26 | 0.27 | | | | | | | | 0.24 | | | | 0.32 | |
| BDL111 | 8103.1 | Av. | 1.12 | 1.11 | 1.13 | 2.19 | | | | | | | | 2.28 | | | | 1.58 | |
| BDL111 | 8103.2 | P | | | | 0.96 | | 0.51 | 0.20 | | | | | 0.88 | 0.68 | 0.34 | 0.33 | | |
| BDL111 | 8103.2 | Av. | | | | 1.35 | | 1.16 | 1.53 | | | | | 2.21 | 1.21 | 1.47 | 2.07 | | |
| BDL111 | 8103.4 | P | | | | 0.90 | | | | | | | | 0.79 | | | | 0.83 | |
| BDL111 | 8103.4 | Av. | | | | 1.51 | | | | | | | | 2.47 | | | | 1.42 | |
| BDL111 | 8103.5 | P | | | | 0.88 | | 0.58 | | | | | | 0.82 | | 0.53 | 0.69 | | |
| BDL111 | 8103.5 | Av. | | | | 2.94 | | 1.19 | | | | | | 4.21 | | 1.46 | 1.37 | | |
| BDL112 | 7502.1 | P | | | | | 0.69 | | 0.43 | | | | | | 0.44 | | 0.37 | | 0.32 |
| BDL112 | 7502.1 | Av. | | | | | 1.20 | | 2.10 | | | | | | 1.46 | | 2.26 | | 1.63 |
| BDL112 | 7502.14 | P | | | | 0.52 | 0.50 | 0.57 | | | | | | 0.50 | 0.48 | 0.47 | | | 0.46 |
| BDL112 | 7502.14 | Av. | | | | 1.67 | 3.18 | 1.34 | | | | | | 1.44 | 3.42 | 1.55 | | | 2.15 |
| BDL112 | 7502.4 | P | | | | 0.19 | | | 0.75 | | | | | 0.11 | 0.29 | 0.02 | 0.44 | 0.65 | 0.51 |
| BDL112 | 7502.4 | Av. | | | | 2.17 | | | 1.18 | | | | | 2.04 | 1.46 | 1.24 | 1.48 | 1.24 | 1.36 |
| BDL112 | 7502.7 | P | | | | 0.19 | | 0.19 | | | | | | 0.07 | 0.18 | 0.00 | 0.84 | | 0.25 |
| BDL112 | 7502.7 | Av. | | | | 1.88 | | 1.36 | | | | | | 1.70 | 1.36 | 1.44 | 1.13 | | 1.52 |
| BDL112 | 7502.9 | P | | | | | | | 0.30 | | | | | 0.62 | 0.62 | 0.26 | 0.16 | | 0.50 |
| BDL112 | 7502.9 | Av. | | | | | | | 2.12 | | | | | 1.23 | 1.22 | 1.20 | 2.29 | | 1.30 |
| BDL112 | 7502.1 | P | | | | | | | 0.42 | 0.41 | | | | | | | 0.41 | | 0.61 |
| BDL112 | 7502.1 | Av. | | | | | | | 1.29 | 1.15 | | | | | | | 1.27 | | 1.40 |
| BDL112 | 7502.4 | P | 0.58 | | | 0.55 | | | | | | | | 0.48 | | | | 0.18 | |
| BDL112 | 7502.4 | Av. | 1.19 | | | 1.84 | | | | | | | | 2.27 | | | | 2.78 | |
| BDL112 | 7502.7 | P | | | | 0.64 | | | 0.82 | | | | | 0.61 | | 0.71 | 0.72 | | |
| BDL112 | 7502.7 | Av. | | | | 3.88 | | | 1.14 | | | | | 4.86 | | 1.19 | 1.36 | | |
| BDL112 | 7502.8 | P | | | | 0.54 | | 0.67 | 0.57 | | | | | 0.51 | | 0.54 | 0.60 | | |
| BDL112 | 7502.8 | Av. | | | | 2.50 | | 1.20 | 1.40 | | | | | 2.33 | | 1.41 | 1.52 | | |
| BDL112 | 7502.9 | P | | | | 0.07 | | | 0.79 | | | | | 0.07 | | 0.48 | 0.62 | 0.56 | |
| BDL112 | 7502.9 | Av. | | | | 4.27 | | | 1.11 | | | | | 4.93 | | 1.12 | 1.23 | 1.22 | |
| BDL113 | 7683.4 | P | | | | 0.13 | | 0.00 | 0.69 | | | | | 0.18 | 0.35 | 0.10 | 0.58 | 0.24 | |
| BDL113 | 7683.4 | Av. | | | | 1.51 | | 1.24 | 1.63 | | | | | 1.76 | 1.13 | 1.53 | 2.03 | 1.60 | |
| BDL113 | 7683.6 | P | | | | 0.06 | 0.10 | 0.09 | 0.20 | | | | | 0.01 | 0.04 | 0.00 | 0.02 | | 0.00 |
| BDL113 | 7683.6 | Av. | | | | 2.09 | 1.38 | 1.25 | 1.80 | | | | | 1.93 | 2.10 | 1.67 | 2.80 | | 1.59 |
| BDL113 | 7684.3 | P | | | | 0.24 | 0.56 | 0.38 | 0.62 | | | | | 0.05 | 0.53 | 0.35 | 0.52 | | |
| BDL113 | 7684.3 | Av. | | | | 1.45 | 1.34 | 1.50 | 1.69 | | | | | 1.42 | 1.61 | 1.90 | 2.95 | | |
| BDL113 | 7684.6 | P | | | | 0.12 | | 0.04 | 0.54 | | | | | 0.17 | | 0.00 | 0.51 | | |
| BDL113 | 7684.6 | Av. | | | | 1.81 | | 1.29 | 3.37 | | | | | 1.68 | | 1.63 | 4.60 | | |
| BDL113 | 7684.7 | P | | | | | | 0.57 | 0.90 | | | | | | | 0.31 | 0.70 | | |
| BDL113 | 7684.7 | Av. | | | | | | 1.15 | 1.19 | | | | | | | 1.59 | 1.88 | | |
| BDL113 | 7683.1 | P | | | | 0.18 | 0.41 | 0.63 | 0.16 | | | | | 0.23 | 0.33 | 0.06 | 0.11 | | 0.61 |
| BDL113 | 7683.1 | Av. | | | | 4.92 | 1.37 | 1.11 | 1.68 | | | | | 6.15 | 1.83 | 1.32 | 2.01 | | 2.09 |
| BDL113 | 7683.11 | P | | | | | 0.00 | | | | | | | | 0.00 | | | | |
| BDL113 | 7683.11 | Av. | | | | | 3.76 | | | | | | | | 4.28 | | | | |
| BDL113 | 7683.4 | P | | | | | 0.29 | | 0.47 | | | | | 0.94 | 0.36 | | 0.47 | | 0.78 |
| BDL113 | 7683.4 | Av. | | | | | 1.28 | | 1.32 | | | | | 1.72 | 1.56 | | 1.62 | | 1.47 |
| BDL113 | 7684.1 | P | | | | | | | | | | | | | | | | | |
| BDL113 | 7684.1 | Av. | | | | | | | | | | | | | | | | | |
| BDL113 | 7684.5 | P | | | | | 0.00 | | | | | | | | 0.00 | | | | |
| BDL113 | 7684.5 | Av. | | | | | 3.01 | | | | | | | | 4.03 | | | | |
| BDL114 | 7741.3 | P | | | | | 0.41 | 0.12 | 0.30 | | | | | | 0.40 | 0.00 | 0.23 | | 0.53 |
| BDL114 | 7741.3 | Av. | | | | | 3.87 | 1.92 | 3.64 | | | | | | 4.33 | 2.51 | 4.94 | | 2.47 |
| BDL114 | 7741.6 | P | | | | 0.36 | 0.50 | | 0.01 | | | | | 0.58 | 0.49 | | 0.06 | | 0.43 |
| BDL114 | 7741.6 | Av. | | | | 1.37 | 12.18 | | 2.96 | | | | | 1.16 | 4.68 | | 2.99 | | 3.15 |
| BDL114 | 7742.1 | P | | | | 0.36 | | | | | | | | 0.30 | 0.30 | | | | 0.50 |
| BDL114 | 7742.1 | Av. | | | | 1.56 | | | | | | | | 1.35 | 1.21 | | | | 1.29 |
| BDL114 | 7742.3 | P | | | | 0.39 | 0.23 | 0.59 | | | | | | 0.29 | 0.00 | 0.02 | | | 0.10 |
| BDL114 | 7742.3 | Av. | | | | 4.22 | 1.73 | 1.24 | | | | | | 2.30 | 2.68 | 1.73 | | | 1.70 |
| BDL114 | 7742.5 | P | | | | 0.16 | 0.25 | 0.18 | 0.63 | | | | | 0.00 | 0.25 | 0.13 | 0.27 | | 0.53 |
| BDL114 | 7742.5 | Av. | | | | 3.66 | 1.85 | 1.38 | 1.33 | | | | | 2.39 | 2.81 | 2.01 | 2.23 | | 1.62 |
| BDL115 | 8152.3 | P | | | | 0.05 | | | | | | | | 0.34 | | | | | |
| BDL115 | 8152.3 | Av. | | | | 1.28 | | | | | | | | 1.14 | | | | | |
| BDL115 | 8152.4 | P | 0.13 | | | | | 0.71 | 0.08 | | | | | | | 0.79 | 0.08 | 0.39 | |
| BDL115 | 8152.4 | Av. | 1.16 | | | | | 1.15 | 2.16 | | | | | | | 1.11 | 2.20 | 1.39 | |
| BDL115 | 8154.1 | P | | | | | | | 0.40 | | | | | | | | 0.36 | | 0.60 |
| BDL115 | 8154.1 | Av. | | | | | | | 2.40 | | | | | | | | 2.88 | | 1.11 |
| BDL115 | 8155.2 | P | | | | | 0.51 | | 0.26 | | | | | | 0.52 | | 0.26 | | 0.54 |
| BDL115 | 8155.2 | Av. | | | | | 2.70 | | 2.22 | | | | | | 3.09 | | 2.28 | | 2.66 |
| BDL115 | 8155.4 | P | | | | 0.36 | 0.48 | | | | | | | 0.25 | 0.47 | | | | 0.53 |
| BDL115 | 8155.4 | Av. | | | | 2.31 | 1.84 | | | | | | | 1.88 | 2.66 | | | | 2.33 |
| BDL115 | 8152.3 | P | | | | 0.43 | 0.35 | 0.01 | 0.36 | | | | | 0.37 | 0.20 | 0.24 | 0.09 | | |
| BDL115 | 8152.3 | Av. | | | | 1.84 | 1.26 | 1.22 | 1.88 | | | | | 1.96 | 1.41 | 1.51 | 2.04 | | |
| BDL115 | 8152.4 | P | | | | 0.25 | 0.59 | | | | | | | 0.25 | 0.05 | 0.15 | 0.41 | | |
| BDL115 | 8152.4 | Av. | | | | 2.58 | 1.13 | | | | | | | 2.87 | 1.61 | 1.42 | 1.30 | | |
| BDL115 | 8154.1 | P | | | | 0.02 | | 0.27 | | | | | | 0.16 | | 0.12 | | | |
| BDL115 | 8154.1 | Av. | | | | 5.48 | | 1.16 | | | | | | 5.83 | | 1.36 | | | |
| BDL115 | 8155.2 | P | | | | 0.05 | | 0.24 | | | | | | 0.20 | | 0.13 | 0.80 | 0.85 | |
| BDL115 | 8155.2 | Av. | | | | 3.97 | | 1.36 | | | | | | 3.99 | | 1.33 | 1.13 | 1.25 | |

TABLE 26-continued

| Gene | Ev. | Par. | 18 | 19 | 20 | 21 | 22 | 23 | 24 | 25 | 26 | 27 | 28 | 29 | 30 | 31 | 32 | 33 | 34 |
|---|---|---|---|---|---|---|---|---|---|---|---|---|---|---|---|---|---|---|---|
| BDL115 | 8155.4 | P | 0.52 | | | 0.01 | 0.43 | 0.09 | 0.28 | | | | | 0.02 | | 0.27 | 0.23 | 0.02 | |
| BDL115 | 8155.4 | Av. | 1.11 | | | 4.85 | 1.20 | 1.64 | 1.42 | | | | | 5.32 | | 1.71 | 1.86 | 2.24 | |
| BDL116 | 7481.2 | P | | | | 0.10 | | | | | | | | 0.07 | | | 0.54 | 0.52 | 0.49 |
| BDL116 | 7481.2 | Av. | | | | 1.59 | | | | | | | | 1.64 | | | 1.46 | 1.16 | 1.14 |
| BDL116 | 7481.7 | P | | | | 0.06 | | | 0.51 | | | | | 0.14 | | 0.23 | 0.41 | 0.64 | |
| BDL116 | 7481.7 | Av. | | | | 1.17 | | | 1.40 | | | | | 1.19 | | 1.13 | 1.52 | 1.22 | |
| BDL116 | 7481.8 | P | | | | 0.75 | 0.51 | | 0.32 | | | | | 0.68 | 0.50 | | 0.18 | | 0.54 |
| BDL116 | 7481.8 | Av. | | | | 1.15 | 5.20 | | 1.78 | | | | | 1.17 | 3.75 | | 2.05 | | 1.87 |
| BDL116 | 7482.2 | P | | | | 0.19 | | | 0.22 | | | | | 0.03 | | | 0.16 | 0.35 | |
| BDL116 | 7482.2 | Av. | | | | 1.14 | | | 2.69 | | | | | 1.25 | | | 2.82 | 1.46 | |
| BDL116 | 7485.1 | P | | | | 0.00 | 0.52 | | 0.40 | | | | | 0.02 | 0.29 | 0.07 | 0.37 | | 0.59 |
| BDL116 | 7485.1 | Av. | | | | 2.16 | 1.17 | | 2.56 | | | | | 1.92 | 1.62 | 1.27 | 3.36 | | 1.26 |
| BDL119 | 7732.2 | P | | | | 0.05 | 0.61 | 0.00 | 0.74 | | | | | 0.00 | 0.39 | 0.00 | 0.62 | 0.34 | |
| BDL119 | 7732.2 | Av. | | | | 2.07 | 1.16 | 1.63 | 1.36 | | | | | 1.83 | 1.47 | 2.00 | 1.76 | 1.30 | |
| BDL119 | 7733.2 | P | | | | 0.42 | 0.46 | 0.11 | | | | | | 0.15 | 0.07 | 0.01 | 0.73 | 0.32 | 0.10 |
| BDL119 | 7733.2 | Av. | | | | 1.27 | 1.15 | 1.19 | | | | | | 1.37 | 1.38 | 1.39 | 1.19 | 1.10 | 1.13 |
| BDL119 | 7734.1 | P | | | | 0.23 | | | | | | | | 0.07 | 0.01 | 0.01 | | | 0.00 |
| BDL119 | 7734.1 | Av. | | | | 1.50 | | | | | | | | 1.66 | 1.42 | 1.56 | | | 1.30 |
| BDL119 | 7734.5 | P | | | | 0.37 | 0.26 | 0.62 | 0.69 | | | | | 0.00 | 0.15 | 0.42 | 0.41 | 0.15 | |
| BDL119 | 7734.5 | Av. | | | | 1.12 | 1.37 | 1.16 | 1.16 | | | | | 1.30 | 1.58 | 1.39 | 1.34 | 1.21 | |
| BDL119 | 7734.7 | P | 0.62 | 0.60 | 0.25 | | | 0.58 | 0.54 | | | | | 0.75 | | 0.62 | 0.56 | 0.52 | |
| BDL119 | 7734.7 | Av. | 1.11 | 1.12 | 1.15 | | | 1.41 | 2.92 | | | | | 1.16 | | 1.18 | 2.29 | 1.90 | |
| BDL120 | 7891.3 | P | | | | 0.09 | | | 0.01 | | | | | 0.00 | | 0.01 | 0.01 | 0.43 | |
| BDL120 | 7891.3 | Av. | | | | 3.31 | | | 2.89 | | | | | 2.31 | | 1.30 | 3.58 | 1.24 | |
| BDL120 | 7892.4 | P | | | | 0.23 | | | 0.62 | | | | | 0.12 | 0.31 | | 0.53 | | 0.48 |
| BDL120 | 7892.4 | Av. | | | | 1.53 | | | 1.55 | | | | | 1.46 | 1.36 | | 1.94 | | 1.14 |
| BDL120 | 7892.6 | P | | | | | 0.39 | | 0.60 | | | | | | 0.59 | | 0.58 | 0.69 | |
| BDL120 | 7892.6 | Av. | | | | | 1.20 | | 2.56 | | | | | | 1.13 | | 2.70 | 1.10 | |
| BDL120 | 7893.2 | P | | | | 0.38 | 0.30 | | 0.91 | | | | | 0.43 | 0.14 | | 0.77 | | 0.13 |
| BDL120 | 7893.2 | Av. | | | | 1.48 | 4.78 | | 1.11 | | | | | 1.26 | 5.34 | | 1.42 | | 3.99 |
| BDL120 | 7893.5 | P | 0.02 | 0.46 | | | | | 0.60 | | 0.08 | | | | | | 0.61 | | |
| BDL120 | 7893.5 | Av. | 1.18 | 1.10 | | | | | 2.19 | | 1.04 | | | | | | 2.28 | | |
| BDL122 | 7513.1 | P | | | | | | 0.74 | 0.47 | | | | | | | 0.69 | 0.46 | | |
| BDL122 | 7513.1 | Av. | | | | | | 1.20 | 2.77 | | | | | | | 1.22 | 2.94 | | |
| BDL122 | 7513.1 | P | | | | 0.49 | | | 0.80 | | | | | 0.35 | | | 0.83 | 0.35 | |
| BDL122 | 7513.1 | Av. | | | | 1.56 | | | 1.40 | | | | | 1.57 | | | 1.31 | 1.70 | |
| BDL122 | 7513.14 | P | | | | 0.17 | | | 0.19 | | | | | 0.17 | 0.53 | | 0.06 | | 0.59 |
| BDL122 | 7513.14 | Av. | | | | 1.87 | | | 1.82 | | | | | 1.82 | 1.26 | | 2.38 | | 1.27 |
| BDL122 | 7513.9 | P | | | | 0.01 | 0.46 | | 0.52 | | | | | 0.00 | 0.44 | | 0.52 | | 0.45 |
| BDL122 | 7513.9 | Av. | | | | 1.79 | 2.20 | | 4.29 | | | | | 1.57 | 3.19 | | 4.97 | | 3.28 |
| BDL122 | 7514.3 | P | | 0.22 | 0.15 | | 0.58 | | 0.57 | 0.01 | | 0.04 | | | 0.61 | | 0.65 | | 0.55 |
| BDL122 | 7514.3 | Av. | | 1.29 | 1.23 | | 1.68 | | 2.10 | 1.12 | | 1.03 | | | 2.11 | | 1.63 | | 2.58 |
| BDL122 | 7513.1 | P | 0.17 | 0.09 | | 0.01 | | | | | | | | 0.02 | | | | 0.12 | |
| BDL122 | 7513.1 | Av. | 1.18 | 1.11 | | 4.25 | | | | | | | | 4.24 | | | | 1.89 | |
| BDL122 | 7513.14 | P | 0.50 | | | 0.88 | | | | | | | | 0.74 | | | | 0.54 | |
| BDL122 | 7513.14 | Av. | 1.13 | | | 1.32 | | | | | | | | 1.97 | | | | 3.21 | |
| BDL122 | 7513.9 | P | 0.31 | | | 0.35 | | | 0.86 | | | | | 0.31 | | | | 0.37 | |
| BDL122 | 7513.9 | Av. | 1.19 | | | 4.01 | | | 1.34 | | | | | 3.97 | | | | 2.13 | |
| BDL122 | 7514.3 | P | | | | 0.32 | | | | | | | | 0.28 | | | | 0.81 | |
| BDL122 | 7514.3 | Av. | | | | 2.36 | | | | | | | | 2.69 | | | | 1.22 | |
| BDL123 | 8082.1 | P | | 0.31 | 0.09 | | | | 0.06 | | | | | | | | 0.11 | | 0.17 |
| BDL123 | 8082.1 | Av. | | 1.16 | 1.12 | | | | 2.47 | | | | | | | | 2.20 | | 1.37 |
| BDL123 | 8082.3 | P | | 0.14 | 0.48 | | | | 0.26 | 0.05 | | 0.04 | | | | | 0.40 | | |
| BDL123 | 8082.3 | Av. | | 1.11 | 1.12 | | | | 2.00 | 1.13 | | 1.02 | | | | | 1.85 | | |
| BDL123 | 8082.6 | P | | | | | | | | | | | | | | | | | |
| BDL123 | 8082.6 | Av. | | | | | | | | | | | | | | | | | |
| BDL123 | 8083.2 | P | | | | 0.64 | 0.53 | | 0.81 | | | | | 0.56 | 0.55 | | 0.86 | | 0.62 |
| BDL123 | 8083.2 | Av. | | | | 1.39 | 3.11 | | 1.43 | | | | | 1.36 | 3.02 | | 1.27 | | 1.69 |
| BDL123 | 8083.3 | P | 0.07 | 0.00 | | | | | 0.39 | 0.01 | | | | | | | 0.28 | | |
| BDL123 | 8083.3 | Av. | 1.37 | 1.32 | | | | | 1.77 | 1.15 | | | | | | | 1.75 | | |
| BDL124 | 8482.1 | P | | | | 0.38 | | 0.31 | | | | | | 0.22 | 0.00 | 0.29 | 0.35 | 0.00 | |
| BDL124 | 8482.1 | Av. | | | | 2.25 | | 1.48 | | | | | | 1.85 | 1.50 | 2.12 | 1.54 | 1.20 | |
| BDL125 | 7491.1 | P | 0.21 | | 0.06 | | | | 0.20 | | | | | | | | 0.15 | | |
| BDL125 | 7491.1 | Av. | 1.23 | | 1.18 | | | | 5.44 | | | | | | | | 4.43 | | |
| BDL125 | 7491.5 | P | | | | | | | 0.51 | | | | | | | | 0.55 | | |
| BDL125 | 7491.5 | Av. | | | | | | | 1.67 | | | | | | | | 1.56 | | |
| BDL125 | 7492.5 | P | | | | 0.72 | | | | | | | | 0.66 | | | | 0.65 | |
| BDL125 | 7492.5 | Av. | | | | 1.11 | | | | | | | | 1.16 | | | | 1.38 | |
| BDL125 | 7494.1 | P | | | | 0.46 | | 0.78 | 0.44 | | | | | 0.43 | | 0.77 | 0.41 | | |
| BDL125 | 7494.1 | Av. | | | | 1.41 | | 1.12 | 2.37 | | | | | 1.24 | | 1.13 | 2.53 | | |
| BDL125 | 7495.5 | P | | | | 0.36 | | | 0.43 | | | | | 0.02 | | | 0.31 | 0.23 | |
| BDL125 | 7495.5 | Av. | | | | 1.22 | | | 2.05 | | | | | 1.34 | | | 2.25 | 1.54 | |
| BDL128 | 7711.3 | P | | | | 0.11 | 0.72 | 0.46 | 0.66 | | | | | 0.14 | 0.73 | 0.32 | 0.63 | | |
| BDL128 | 7711.3 | Av. | | | | 1.44 | 1.14 | 1.14 | 1.90 | | | | | 1.32 | 1.18 | 1.18 | 2.03 | | |
| BDL128 | 8361.5 | P | | | | 0.36 | 0.45 | | | | | | | 0.61 | 0.50 | | | | 0.59 |
| BDL128 | 8361.5 | Av. | | | | 1.24 | 1.80 | | | | | | | 1.14 | 2.15 | | | | 2.09 |
| BDL128 | 8362.2 | P | 0.10 | | | | | | 0.09 | | | | | | | | 0.10 | | |
| BDL128 | 8362.2 | Av. | 1.12 | | | | | | 2.14 | | | | | | | | 2.13 | | |

TABLE 26-continued

| Gene | Ev. | Par. | 18 | 19 | 20 | 21 | 22 | 23 | 24 | 25 | 26 | 27 | 28 | 29 | 30 | 31 | 32 | 33 | 34 |
|---|---|---|---|---|---|---|---|---|---|---|---|---|---|---|---|---|---|---|---|
| BDL128 | 8363.2 | P | | | | 0.42 | | | 0.54 | | | | | 0.36 | 0.00 | | 0.50 | | 0.29 |
| BDL128 | 8363.2 | Av. | | | | 1.88 | | | 3.77 | | | | | 1.84 | 1.54 | | 5.39 | | 1.30 |
| BDL128 | 8365.2 | P | | | | 0.41 | 0.47 | | | | | | | 0.42 | 0.47 | | | | 0.48 |
| BDL128 | 8365.2 | Av. | | | | 1.22 | 2.55 | | | | | | | 1.27 | 3.56 | | | | 3.78 |
| BDL129 | 7691.4 | P | | | | | | | 0.39 | | | | | | 0.65 | 0.00 | 0.16 | | |
| BDL129 | 7691.4 | Av. | | | | | | | 1.53 | | | | | | 1.17 | 1.61 | 2.61 | | |
| BDL129 | 7691.6 | P | | | | 0.20 | | | 0.64 | | | | | 0.04 | 0.21 | 0.52 | 0.38 | | 0.23 |
| BDL129 | 7691.6 | Av. | | | | 1.91 | | | 1.48 | | | | | 1.92 | 1.75 | 1.37 | 2.87 | | 1.38 |
| BDL129 | 7692.2 | P | | | | | 0.50 | | | | | | | | 0.51 | | | | 0.53 |
| BDL129 | 7692.2 | Av. | | | | | 3.65 | | | | | | | | 3.67 | | | | 3.01 |
| BDL129 | 7692.6 | P | | | | | 0.23 | | 0.26 | | | | | | | | 0.22 | 0.08 | |
| BDL129 | 7692.6 | Av. | | | | | 1.12 | | 2.87 | | | | | | | | 3.20 | 1.17 | |
| BDL129 | 7693.1 | P | | | | 0.35 | 0.47 | 0.00 | 0.21 | | | | | 0.27 | 0.45 | 0.00 | 0.23 | | 0.52 |
| BDL129 | 7693.1 | Av. | | | | 1.50 | 4.24 | 1.22 | 3.15 | | | | | 1.43 | 4.30 | 1.44 | 4.15 | | 3.58 |
| BDL130 | 7663.1 | P | | | | | | | | | | 0.03 | | | | | | 0.48 | |
| BDL130 | 7663.1 | Av. | | | | | | | | | | 1.02 | | | | | | 1.14 | |
| BDL130 | 7663.3 | P | | | | 0.39 | 0.39 | 0.33 | | | | | | 0.13 | 0.23 | 0.24 | 0.59 | | 0.06 |
| BDL130 | 7663.3 | Av. | | | | 4.91 | 1.51 | 1.44 | | | | | | 2.34 | 2.51 | 2.32 | 1.93 | | 1.37 |
| BDL130 | 7663.6 | P | | | | | | 0.36 | 0.48 | | | | | | | 0.48 | 0.41 | 0.40 | |
| BDL130 | 7663.6 | Av. | | | | | | 1.30 | 2.15 | | | | | | | 1.30 | 2.24 | 1.28 | |
| BDL130 | 7664.5 | P | | | | | | 0.76 | | | | | | | | 0.76 | | 0.09 | |
| BDL130 | 7664.5 | Av. | | | | | | 1.17 | | | | | | | | 1.20 | | 1.06 | |
| BDL131 | 7461.2 | P | 0.02 | 0.01 | 0.14 | | | | 0.54 | 0.06 | | | | | | | 0.67 | | 0.01 |
| BDL131 | 7461.2 | Av. | 1.18 | 1.33 | 1.22 | | | | 1.74 | 1.10 | | | | | | | 1.48 | | 1.28 |
| BDL131 | 7461.4 | P | 0.14 | 0.06 | 0.24 | | | | | 0.09 | 0.00 | 0.00 | 0.06 | | | | | | |
| BDL131 | 7461.4 | Av. | 1.12 | 1.14 | 1.11 | | | | | 1.08 | 1.05 | 1.04 | 1.02 | | | | | | |
| BDL131 | 7462.2 | P | 0.00 | 0.08 | 0.01 | | | | 0.66 | 0.30 | 0.04 | 0.08 | | | | | 0.70 | | |
| BDL131 | 7462.2 | Av. | 1.38 | 1.43 | 1.25 | | | | 3.42 | 1.12 | 1.07 | 1.05 | | | | | 2.57 | | |
| BDL131 | 7463.4 | P | | | 0.19 | | | | 0.85 | | | 0.02 | | | | | 0.93 | | |
| BDL131 | 7463.4 | Av. | | | 1.11 | | | | 1.25 | | | 1.03 | | | | | 1.10 | | |
| BDL131 | 7464.5 | P | | | | | 0.01 | 0.01 | 0.16 | | | | | | 0.21 | 0.49 | 0.04 | | 0.38 |
| BDL131 | 7464.5 | Av. | | | | | 1.26 | 1.19 | 2.44 | | | | | | 1.29 | 1.17 | 2.63 | | 1.15 |
| BDL132 | 7471.1 | P | 0.07 | 0.09 | | 0.43 | | | 0.67 | | | | | | | | 0.71 | 0.13 | |
| BDL132 | 7471.1 | Av. | 1.31 | 1.21 | | 1.17 | | | 1.76 | | | | | | | | 1.57 | 1.41 | |
| BDL132 | 7471.4 | P | 0.51 | 0.07 | 0.09 | | | | 0.26 | | | | | | | | 0.27 | 0.76 | 0.68 |
| BDL132 | 7471.4 | Av. | 1.11 | 1.20 | 1.13 | | | | 3.00 | | | | | | | | 2.64 | 1.19 | 1.20 |
| BDL132 | 7472.4 | P | | | | 0.48 | | | 0.94 | | | | | 0.48 | | | 0.96 | | |
| BDL132 | 7472.4 | Av. | | | | 1.33 | | | 1.18 | | | | | 1.27 | | | 1.12 | | |
| BDL132 | 7473.1 | P | | 0.00 | 0.39 | | 0.48 | | | | | 0.03 | | | 0.51 | | | | 0.40 |
| BDL132 | 7473.1 | Av. | | 1.27 | 1.15 | | 1.70 | | | | | 1.02 | | | 2.06 | | | | 2.66 |
| BDL132 | 7474.4 | P | | | | 0.20 | 0.51 | 0.09 | | | | | | 0.17 | 0.51 | 0.02 | 0.81 | 0.89 | 0.56 |
| BDL132 | 7474.4 | Av. | | | | 1.74 | 1.92 | 1.20 | | | | | | 1.74 | 2.41 | 1.29 | 1.16 | 1.15 | 1.87 |
| BDL132 | 7471.1 | P | | | | 0.01 | | | | | | | | 0.00 | 0.75 | | | 0.32 | |
| BDL132 | 7471.1 | Av. | | | | 4.76 | | | | | | | | 6.37 | 1.12 | | | 2.49 | |
| BDL132 | 7471.4 | P | | | | 0.08 | | 0.20 | 0.61 | | | | | 0.11 | | 0.00 | 0.18 | 0.16 | |
| BDL132 | 7471.4 | Av. | | | | 5.36 | | 1.12 | 1.16 | | | | | 6.92 | | 1.49 | 1.50 | 3.72 | |
| BDL132 | 7472.4 | P | | | | 0.05 | | | | | | | | 0.04 | | | 0.54 | | |
| BDL132 | 7472.4 | Av. | | | | 3.38 | | | | | | | | 3.70 | | | 1.22 | | |
| BDL132 | 7473.1 | P | | | | | | | | | | | | | 0.83 | 0.36 | 0.62 | 0.38 | |
| BDL132 | 7473.1 | Av. | | | | | | | | | | | | | 1.13 | 1.27 | 1.16 | 1.35 | |
| BDL132 | 7475.4 | P | | | | | | | 0.13 | | | | | | 0.72 | 0.76 | 0.11 | | 0.51 |
| BDL132 | 7475.4 | Av. | | | | | | | 1.64 | | | | | | 1.22 | 1.11 | 1.73 | | 1.40 |
| BDL133 | 8161.1 | P | | | | 0.34 | 0.26 | 0.47 | | | | | | 0.39 | 0.27 | 0.02 | | | 0.30 |
| BDL133 | 8161.1 | Av. | | | | 1.55 | 1.14 | 1.28 | | | | | | 1.41 | 1.32 | 1.35 | | | 1.18 |
| BDL133 | 8161.2 | P | 0.04 | 0.05 | 0.02 | | 0.31 | 0.46 | 0.01 | 0.16 | | | | | 0.46 | | 0.01 | | 0.35 |
| BDL133 | 8161.2 | Av. | 1.08 | 1.17 | 1.13 | | 1.31 | 1.20 | 2.62 | 1.16 | | | | | 1.18 | | 2.22 | | 1.20 |
| BDL133 | 8161.3 | P | | 0.17 | 0.00 | 0.48 | 0.09 | | 0.71 | | | | | 0.39 | | | 0.82 | 0.36 | |
| BDL133 | 8161.3 | Av. | | 1.11 | 1.20 | 7.63 | 1.19 | | 1.59 | | | | | 2.03 | | | 1.29 | 2.21 | |
| BDL133 | 8161.4 | P | | | | 0.02 | 0.53 | 0.00 | | | | | | 0.00 | 0.04 | 0.01 | | 0.20 | |
| BDL133 | 8161.4 | Av. | | | | 1.26 | 1.15 | 1.46 | | | | | | 1.47 | 1.28 | 1.60 | | 1.61 | |
| BDL133 | 8162.1 | P | | | | | 0.27 | 0.01 | 0.54 | | | | | 0.06 | 0.10 | 0.00 | 0.39 | 0.13 | 0.34 |
| BDL133 | 8162.1 | Av. | | | | | 1.15 | 1.41 | 1.27 | | | | | 1.17 | 1.37 | 1.59 | 1.50 | 1.16 | 1.11 |
| BDL133 | 8162.3 | P | | | | | | | | | | | 0.05 | | | | | 0.11 | 0.48 |
| BDL133 | 8162.3 | Av. | | | | | | | | | | | 1.02 | | | | | 1.49 | 1.16 |
| BDL133 | 8162.5 | P | | 0.08 | 0.19 | | | | 0.00 | | | | | | | | 0.00 | 0.25 | 0.02 |
| BDL133 | 8162.5 | Av. | | 1.12 | 1.19 | | | | 3.57 | | | | | | | | 2.84 | 1.23 | 1.17 |
| BDL133 | 8163.2 | P | | | | | 0.59 | | 0.74 | | | | | | 0.57 | 0.78 | 0.65 | | |
| BDL133 | 8163.2 | Av. | | | | | 1.53 | | 1.26 | | | | | | 1.69 | 1.33 | 1.53 | | |
| BDL134 | 7671.2 | P | | | | 0.00 | 0.23 | 0.14 | | | | | | 0.00 | 0.08 | 0.07 | 0.49 | 0.17 | |
| BDL134 | 7671.2 | Av. | | | | 1.93 | 1.18 | 1.20 | | | | | | 1.94 | 1.73 | 1.76 | 1.38 | 1.39 | |
| BDL134 | 7672.1 | P | | | | 0.01 | | | | | | | | 0.00 | 0.00 | 0.07 | 0.45 | 0.14 | 0.46 |
| BDL134 | 7672.1 | Av. | | | | 3.86 | | | | | | | | 2.37 | 1.49 | 1.38 | 1.31 | 1.46 | 1.27 |
| BDL134 | 7673.1 | P | | | | 0.46 | 0.46 | 0.40 | 0.77 | | | | | 0.18 | 0.09 | 0.06 | 0.06 | 0.17 | |
| BDL134 | 7673.1 | Av. | | | | 11.84 | 1.30 | 1.26 | 1.10 | | | | | 2.40 | 2.03 | 2.04 | 1.95 | 1.14 | |
| BDL134 | 7673.2 | P | | | | 0.19 | 0.39 | 0.26 | 0.01 | | | | | 0.18 | 0.11 | 0.16 | 0.00 | 0.62 | |
| BDL134 | 7673.2 | Av. | | | | 1.67 | 1.26 | 1.42 | 2.03 | | | | | 1.66 | 1.62 | 1.78 | 2.56 | 1.20 | |
| BDL135 | 7722.1 | P | | | | | 0.51 | 0.34 | 0.66 | | | | | 0.07 | 0.45 | 0.43 | 0.64 | 0.24 | 0.10 |
| BDL135 | 7722.1 | Av. | | | | | 1.13 | 1.11 | 1.85 | | | | | 1.14 | 1.17 | 1.11 | 1.86 | 1.25 | 1.11 |

TABLE 26-continued

| Gene | Ev. | Par. | 18 | 19 | 20 | 21 | 22 | 23 | 24 | 25 | 26 | 27 | 28 | 29 | 30 | 31 | 32 | 33 | 34 |
|---|---|---|---|---|---|---|---|---|---|---|---|---|---|---|---|---|---|---|---|
| BDL135 | 7723.1 | P | | | | | | | | | | 0.02 | | | | | | | 0.24 |
| BDL135 | 7723.1 | Av. | | | | | | | | | | 1.02 | | | | | | | 1.22 |
| BDL135 | 7723.3 | P | | | | | | 0.43 | 0.27 | | | | | 0.51 | | 0.06 | 0.29 | 0.02 | |
| BDL135 | 7723.3 | Av. | | | | | | 1.13 | 5.05 | | | | | 1.20 | | 1.29 | 6.62 | 1.34 | |
| BDL135 | 7723.8 | P | | | | 0.72 | | | | | | | | 0.61 | | | | 0.35 | 0.26 |
| BDL135 | 7723.8 | Av. | | | | 1.12 | | | | | | | | 1.13 | | | | 1.10 | 1.13 |
| BDL135 | 7723.9 | P | 0.03 | 0.12 | 0.05 | | | | | 0.17 | 0.04 | | | | | | | 0.29 | |
| BDL135 | 7723.9 | Av. | 1.19 | 1.15 | 1.12 | | | | | 1.16 | 1.03 | | | | | | | 1.21 | |
| BDL136 | 7751.4 | P | | | | | 0.19 | 0.57 | | | | | | | 0.19 | 0.48 | | | |
| BDL136 | 7751.4 | Av. | | | | | 1.26 | 1.18 | | | | | | | 1.21 | 1.19 | | | |
| BDL136 | 7751.5 | P | | | | 0.53 | | 0.75 | 0.53 | | | | | 0.39 | 0.44 | 0.44 | 0.36 | 0.01 | |
| BDL136 | 7751.5 | Av. | | | | 1.57 | | 1.12 | 1.40 | | | | | 1.49 | 1.35 | 1.41 | 1.77 | 1.12 | |
| BDL136 | 7751.8 | P | 0.03 | 0.02 | 0.05 | | | | | 0.05 | 0.10 | | | | | | | 0.39 | |
| BDL136 | 7751.8 | Av. | 1.20 | 1.23 | 1.31 | | | | | 1.08 | 1.02 | | | | | | | 1.14 | |
| BDL136 | 7752.6 | P | | | | | | | | | | | | | | | | 0.12 | |
| BDL136 | 7752.6 | Av. | | | | | | | | | | | | | | | | 1.35 | |
| BDL137 | 7701.2 | P | | 0.21 | 0.05 | 0.50 | | | | | | 0.06 | | 0.47 | | | | 0.40 | 0.05 |
| BDL137 | 7701.2 | Av. | | 1.15 | 1.14 | 5.92 | | | | | | 1.02 | | 1.90 | | | | 2.37 | 1.21 |
| BDL137 | 7701.5 | P | | | | 0.61 | | | 0.73 | | | | | 0.47 | | | 0.68 | | 0.68 |
| BDL137 | 7701.5 | Av. | | | | 1.28 | | | 1.41 | | | | | 1.23 | | | 1.57 | | 1.12 |
| BDL137 | 7701.6 | P | | | | 0.84 | | | 0.75 | | | | | 0.73 | | | 0.76 | 0.01 | 0.14 |
| BDL137 | 7701.6 | Av. | | | | 1.10 | | | 1.42 | | | | | 1.15 | | | 1.41 | 1.30 | 1.13 |
| BDL137 | 7702.1 | P | | | | 0.19 | 0.14 | | 0.25 | | | | | 0.02 | 0.10 | 0.00 | 0.15 | | 0.00 |
| BDL137 | 7702.1 | Av. | | | | 2.42 | 1.29 | | 1.38 | | | | | 1.95 | 1.94 | 1.49 | 2.00 | | 1.42 |
| BDL137 | 7703.2 | P | | | | | 0.41 | 0.45 | 0.59 | | | | | 0.35 | 0.41 | 0.46 | 0.61 | 0.30 | |
| BDL137 | 7703.2 | Av. | | | | | 1.55 | 1.52 | 2.47 | | | | | 1.15 | 1.50 | 1.59 | 2.22 | 1.27 | |
| BDL137 | 7703.3 | P | | | | | | 0.32 | | | | | | 0.01 | 0.18 | 0.30 | 0.52 | 0.19 | |
| BDL137 | 7703.3 | Av. | | | | | | 1.19 | | | | | | 1.25 | 1.23 | 1.42 | 1.20 | 1.27 | |
| BDL137 | 7703.7 | P | | | | | | 0.53 | 0.55 | | | | | | 0.53 | 0.53 | 0.41 | 0.17 | |
| BDL137 | 7703.7 | Av. | | | | | | 1.12 | 1.45 | | | | | | 1.16 | 1.18 | 1.42 | 1.32 | |
| BDL139 | 8131.1 | P | | | | | | | | | | | | | | | | | |
| BDL139 | 8131.1 | Av. | | | | | | | | | | | | | | | | | |
| BDL139 | 8131.2 | P | | | | 0.12 | 0.44 | 0.10 | 0.83 | | | | | 0.00 | 0.27 | 0.00 | 0.64 | 0.38 | 0.50 |
| BDL139 | 8131.2 | Av. | | | | 1.70 | 1.21 | 1.21 | 1.19 | | | | | 1.79 | 1.78 | 1.71 | 1.64 | 1.20 | 1.18 |
| BDL139 | 8132.7 | P | | | | | | | | | | | | | | | | | |
| BDL139 | 8132.7 | Av. | | | | | | | | | | | | | | | | | |
| BDL139 | 8133.2 | P | | | | | | | | | | | | | | | | | |
| BDL139 | 8133.2 | Av. | | | | | | | | | | | | | | | | | |
| BDL141 | 8141.2 | P | | | | | | | | | | | | 0.30 | | | | 0.01 | |
| BDL141 | 8141.2 | Av. | | | | | | | | | | | | 1.12 | | | | 1.13 | |
| BDL141 | 8142.2 | P | | | | | | | | | | | | | | | | | |
| BDL141 | 8142.2 | Av. | | | | | | | | | | | | | | | | | |
| BDL142 | 8282.1 | P | | | | 0.43 | 0.35 | 0.52 | 0.15 | | | | | 0.27 | 0.38 | 0.42 | 0.13 | 0.01 | |
| BDL142 | 8282.1 | Av. | | | | 1.17 | 1.21 | 1.20 | 1.47 | | | | | 1.31 | 1.37 | 1.33 | 1.49 | 1.25 | |
| BDL142 | 8283.1 | P | | | | 0.27 | | | 0.26 | | | | | 0.14 | 0.03 | 0.65 | 0.24 | | 0.33 |
| BDL142 | 8283.1 | Av. | | | | 4.32 | | | 1.94 | | | | | 2.12 | 1.30 | 1.17 | 2.04 | | 1.10 |
| BDL142 | 8283.2 | P | 0.04 | | 0.01 | | | | | | | | | | | | | 0.30 | |
| BDL142 | 8283.2 | Av. | 1.07 | | 1.14 | | | | | | | | | | | | | 1.42 | |
| BDL142 | 8284.1 | P | | | | | | 0.68 | | | | | | 0.35 | | 0.64 | 0.85 | 0.29 | 0.17 |
| BDL142 | 8284.1 | Av. | | | | | | 1.18 | | | | | | 1.20 | | 1.23 | 1.11 | 1.21 | 1.13 |
| BDL142 | 8285.3 | P | | | | 0.21 | | | 0.60 | | | | | 0.14 | 0.45 | 0.61 | 0.56 | 0.22 | 0.03 |
| BDL142 | 8285.3 | Av. | | | | 2.01 | | | 1.50 | | | | | 1.82 | 1.21 | 1.28 | 1.66 | 1.40 | 1.16 |
| BDL142 | 8285.5 | P | | | | | | | 0.52 | | | | | | | | 0.65 | 0.36 | |
| BDL142 | 8285.5 | Av. | | | | | | | 1.33 | | | | | | | | 1.26 | 1.29 | |
| BDL143 | 8411.1 | P | 0.00 | 0.00 | 0.11 | | | | | 0.15 | 0.00 | 0.02 | 0.02 | | | | | 0.06 | |
| BDL143 | 8411.1 | Av. | 1.28 | 1.24 | 1.41 | | | | | 1.17 | 1.05 | 1.02 | 1.03 | | | | | 1.17 | |
| BDL143 | 8411.5 | P | | | | | | | 0.91 | | | | | | | | | | 0.17 |
| BDL143 | 8411.5 | Av. | | | | | | | 1.24 | | | | | | | | | | 1.11 |
| BDL143 | 8412.2 | P | | | | 0.31 | 0.43 | 0.09 | 0.77 | | | | | 0.00 | 0.24 | 0.13 | 0.69 | | 0.02 |
| BDL143 | 8412.2 | Av. | | | | 1.22 | 1.24 | 1.49 | 1.35 | | | | | 1.31 | 1.51 | 1.63 | 1.52 | | 1.34 |
| BDL143 | 8412.4 | P | | | | | 0.23 | 0.63 | 0.59 | | | | | | 0.03 | 0.42 | 0.28 | | 0.78 |
| BDL143 | 8412.4 | Av. | | | | | 1.14 | 1.21 | 1.26 | | | | | | 1.80 | 1.90 | 2.17 | | 1.22 |
| BDL143 | 8413.3 | P | | | | 0.09 | 0.42 | 0.03 | 0.43 | | | | | 0.00 | 0.27 | 0.00 | 0.31 | 0.44 | |
| BDL143 | 8413.3 | Av. | | | | 1.69 | 1.28 | 1.29 | 1.40 | | | | | 1.61 | 1.50 | 1.55 | 1.64 | 1.20 | |
| BDL143 | 8414.4 | P | | | | | | 0.34 | 0.68 | | | | | 0.73 | 0.66 | 0.07 | 0.67 | | |
| BDL143 | 8414.4 | Av. | | | | | | 1.16 | 1.72 | | | | | 1.17 | 1.13 | 1.25 | 1.68 | | |
| BDL143 | 8414.5 | P | | | | 0.35 | 0.60 | 0.20 | | | | | | 0.26 | 0.40 | 0.30 | | | 0.29 |
| BDL143 | 8414.5 | Av. | | | | 1.23 | 1.13 | 1.19 | | | | | | 1.28 | 1.38 | 1.40 | | | 1.13 |
| BDL144 | 8384.1 | P | | | | | | 0.09 | | | | | | 0.35 | | 0.10 | | 0.37 | 0.36 |
| BDL144 | 8384.1 | Av. | | | | | | 1.24 | | | | | | 1.18 | | 1.23 | | 1.17 | 1.35 |
| BDL144 | 8384.5 | P | | | | | | | | | | | | 0.36 | | 0.13 | | | |
| BDL144 | 8384.5 | Av. | | | | | | | | | | | | 1.18 | | 1.24 | | | |
| BDL144 | 8385.1 | P | | | | 0.00 | 0.07 | 0.39 | 0.73 | | | | | 0.00 | 0.05 | 0.00 | 0.06 | | 0.13 |
| BDL144 | 8385.1 | Av. | | | | 2.50 | 1.35 | 1.25 | 1.14 | | | | | 2.06 | 2.23 | 1.86 | 1.71 | | 1.50 |
| BDL145 | 8233.2 | P | | | | 0.25 | | | | | | | | 0.00 | | | 0.73 | 0.08 | |
| BDL145 | 8233.2 | Av. | | | | 1.47 | | | | | | | | 1.47 | | | 1.24 | 1.15 | |
| BDL145 | 8233.3 | P | | | | 0.37 | 0.45 | 0.58 | | | | | | 0.08 | 0.06 | 0.30 | 0.48 | 0.39 | 0.23 |
| BDL145 | 8233.3 | Av. | | | | 9.00 | 1.13 | 1.21 | | | | | | 2.55 | 1.79 | 1.75 | 1.51 | 1.35 | 1.36 |

TABLE 26-continued

| Gene | Ev. | Par. | 18 | 19 | 20 | 21 | 22 | 23 | 24 | 25 | 26 | 27 | 28 | 29 | 30 | 31 | 32 | 33 | 34 |
|---|---|---|---|---|---|---|---|---|---|---|---|---|---|---|---|---|---|---|---|
| BDL145 | 8235.1 | P | | | | 0.36 | | 0.41 | | | | | | 0.22 | | 0.32 | 0.79 | 0.32 | |
| BDL145 | 8235.1 | Av. | | | | 1.25 | | 1.57 | | | | | | 1.27 | | 1.73 | 1.34 | 1.16 | |
| BDL145 | 8235.3 | P | | | | 0.21 | | 0.16 | 0.65 | | | | | 0.02 | 0.14 | 0.00 | 0.43 | 0.41 | 0.38 |
| BDL145 | 8235.3 | Av. | | | | 3.39 | | 1.17 | 1.35 | | | | | 2.32 | 1.87 | 1.92 | 2.33 | 1.31 | 1.21 |
| BDL145 | 8235.4 | P | | | | | | | | | | | | | | | | | |
| BDL145 | 8235.4 | Av. | | | | | | | | | | | | | | | | | |
| BDL146 | 8241.1 | P | 0.29 | 0.42 | 0.72 | | 0.32 | | | | | | | | | | | 0.30 | |
| BDL146 | 8241.1 | Av. | 1.18 | 1.14 | 1.11 | | 1.10 | | | | | | | | | | | 1.37 | |
| BDL146 | 8241.3 | P | | | | 0.10 | | 0.11 | 0.31 | | | | | 0.01 | 0.45 | 0.01 | 0.42 | 0.04 | |
| BDL146 | 8241.3 | Av. | | | | 1.19 | | 1.29 | 1.88 | | | | | 1.26 | 1.24 | 1.41 | 1.96 | 1.08 | |
| BDL146 | 8243.2 | P | | | | | | | 0.62 | | | | | | 0.72 | | 0.59 | 0.15 | 0.05 |
| BDL146 | 8243.2 | Av. | | | | | | | 1.52 | | | | | | 1.12 | | 1.42 | 1.18 | 1.16 |
| BDL146 | 8243.5 | P | | | | 0.50 | 0.59 | 0.68 | | | | | | 0.32 | 0.56 | 0.59 | | 0.62 | 0.70 |
| BDL146 | 8243.5 | Av. | | | | 1.42 | 1.20 | 1.13 | | | | | | 1.46 | 1.47 | 1.34 | | 1.31 | 1.11 |
| BDL146 | 8244.4 | P | 0.29 | 0.21 | 0.33 | | | | 0.77 | | | 0.01 | | | | | 0.89 | | |
| BDL146 | 8244.4 | Av. | 1.15 | 1.17 | 1.30 | | | | 1.39 | | | 1.04 | | | | | 1.17 | | |
| BDL146 | 8244.7 | P | | | | 0.07 | 0.00 | 0.01 | 0.29 | | | | | 0.01 | 0.00 | 0.00 | 0.18 | | 0.47 |
| BDL146 | 8244.7 | Av. | | | | 1.74 | 1.58 | 1.42 | 1.41 | | | | | 1.66 | 2.03 | 1.77 | 1.97 | | 1.26 |
| BDL146 | 8245.2 | P | | | | | | 0.69 | 0.50 | | | | | 0.43 | 0.35 | 0.59 | 0.47 | | |
| BDL146 | 8245.2 | Av. | | | | | | 1.21 | 3.35 | | | | | 1.11 | 1.12 | 1.30 | 3.30 | | |
| BDL146 | 8245.5 | P | | | 0.02 | | | | 0.67 | 0.08 | | | | | | | 0.71 | 0.00 | |
| BDL146 | 8245.5 | Av. | | | 1.13 | | | | 2.48 | 1.07 | | | | | | | 2.05 | 1.25 | |
| BDL42 | 7771.1 | P | | | | | | | | | | | | | | | | | |
| BDL42 | 7771.1 | Av. | | | | | | | | | | | | | | | | | |
| BDL42 | 7772.1 | P | | | | | | | | | | | | | | | | | |
| BDL42 | 7772.1 | Av. | | | | | | | | | | | | | | | | | |
| BDL42 | 7772.7 | P | | | | | | | | | | | | | | | | | |
| BDL42 | 7772.7 | Av. | | | | | | | | | | | | | | | | | |
| BDL42 | 7774.1 | P | | | | 0.01 | 0.15 | 0.35 | 0.73 | | | | | 0.00 | 0.00 | 0.15 | 0.01 | | |
| BDL42 | 7774.1 | Av. | | | | 4.17 | 1.16 | 1.25 | 1.11 | | | | | 2.40 | 2.04 | 2.29 | 2.15 | | |
| BDL42 | 7774.2 | P | | | | | | | | | | | | | | | | | |
| BDL42 | 7774.2 | Av. | | | | | | | | | | | | | | | | | |
| BDL42 | 7774.4 | P | | | | 0.43 | | 0.31 | 0.73 | | | | | 0.24 | 0.06 | 0.00 | 0.12 | 0.46 | |
| BDL42 | 7774.4 | Av. | | | | 3.46 | | 1.18 | 1.10 | | | | | 2.06 | 1.55 | 1.85 | 2.09 | 1.15 | |
| BDL46 | 7833.3 | P | | | | 0.02 | 0.70 | 0.33 | 0.47 | | | | | 0.00 | 0.34 | 0.09 | 0.43 | | 0.31 |
| BDL46 | 7833.3 | Av. | | | | 1.53 | 1.11 | 1.19 | 4.71 | | | | | 1.55 | 1.52 | 1.51 | 6.07 | | 1.24 |
| BDL46 | 7833.4 | P | | | | | | | | | 0.02 | | | | | | | 0.02 | |
| BDL46 | 7833.4 | Av. | | | | | | | | | 1.04 | | | | | | | 1.17 | |
| BDL46 | 7833.5 | P | | | | 0.49 | | | | | | | | 0.43 | | | | | |
| BDL46 | 7833.5 | Av. | | | | 1.55 | | | | | | | | 1.44 | | | | | |
| BDL46 | 7833.6 | P | | | | 0.12 | | 0.54 | 0.52 | | | | | 0.33 | | 0.53 | 0.50 | | |
| BDL46 | 7833.6 | Av. | | | | 1.24 | | 1.74 | 3.06 | | | | | 1.18 | | 1.94 | 3.78 | | |
| BDL46 | 7834.1 | P | | | | | | | | | | | | | | | | | |
| BDL46 | 7834.1 | Av. | | | | | | | | | | | | | | | | | |
| BDL46 | 7833.1 | P | | | | 0.81 | 0.15 | 0.06 | 0.37 | | | | | 0.80 | 0.25 | 0.00 | 0.04 | | |
| BDL46 | 7833.1 | Av. | | | | 2.17 | 1.81 | 1.26 | 1.29 | | | | | 2.21 | 2.29 | 1.66 | 1.76 | | |
| BDL46 | 7833.3 | P | | | | | 0.75 | | | | | | | | 0.30 | 0.00 | 0.79 | | |
| BDL46 | 7833.3 | Av. | | | | | 1.13 | | | | | | | | 1.50 | 1.41 | 1.44 | | |
| BDL46 | 7833.4 | P | | | | | | | | | | | | | | | | | |
| BDL46 | 7833.4 | Av. | | | | | | | | | | | | | | | | | |
| BDL46 | 7833.5 | P | | | | | | 0.54 | | | | | | | | 0.25 | 0.09 | | |
| BDL46 | 7833.5 | Av. | | | | | | 1.22 | | | | | | | | 1.77 | 1.68 | | |
| BDL46 | 7834.4 | P | | | | 0.25 | 0.00 | 0.13 | 0.04 | | | | | 0.41 | 0.00 | 0.04 | 0.00 | | |
| BDL46 | 7834.4 | Av. | | | | 2.23 | 3.05 | 2.50 | 3.07 | | | | | 1.88 | 3.45 | 2.95 | 3.50 | | |
| BDL51 | 7291.1 | P | | | | 0.17 | 0.34 | 0.24 | 0.07 | | | | | 0.06 | 0.22 | 0.13 | 0.04 | | 0.10 |
| BDL51 | 7291.1 | Av. | | | | 2.46 | 1.84 | 1.59 | 3.10 | | | | | 2.14 | 2.30 | 2.12 | 4.63 | | 1.11 |
| BDL51 | 8021.1 | P | | | | | | 0.00 | 0.58 | | | | | | | 0.03 | 0.50 | | |
| BDL51 | 8021.1 | Av. | | | | | | 2.43 | 3.13 | | | | | | | 4.73 | 7.50 | | |
| BDL51 | 8022.4 | P | | | | | 0.02 | 0.31 | 0.63 | | | | | | 0.02 | 0.25 | 0.16 | | 0.49 |
| BDL51 | 8022.4 | Av. | | | | | 2.50 | 1.54 | 1.30 | | | | | | 4.06 | 3.15 | 3.24 | | 1.29 |
| BDL51 | 8022.5 | P | | | | 0.28 | 0.31 | 0.21 | 0.15 | | | | | 0.16 | 0.15 | 0.12 | 0.14 | | |
| BDL51 | 8022.5 | Av. | | | | 3.27 | 2.22 | 1.66 | 2.02 | | | | | 2.40 | 3.77 | 4.00 | 5.31 | | |
| BDL51 | 8024.4 | P | | | | 0.23 | 0.06 | 0.32 | 0.55 | | | | | 0.10 | 0.12 | 0.30 | 0.51 | | 0.85 |
| BDL51 | 8024.4 | Av. | | | | 2.16 | 1.60 | 1.55 | 3.05 | | | | | 1.80 | 2.19 | 2.27 | 4.90 | | 1.14 |
| BDL51 | 8024.7 | P | | | | | | | 0.40 | | | | | | 0.45 | | 0.29 | | 0.79 |
| BDL51 | 8024.7 | Av. | | | | | | | 1.50 | | | | | | 1.12 | | 1.71 | | 1.12 |
| BDL52 | 7861.1 | P | | | | | | 0.64 | | | | | | | | 0.68 | | | |
| BDL52 | 7861.1 | Av. | | | | | | 1.20 | | | | | | | | 1.15 | | | |
| BDL52 | 7861.5 | P | | | | 0.38 | | | 0.03 | | | | | 0.38 | | | 0.04 | | 0.01 |
| BDL52 | 7861.5 | Av. | | | | 1.28 | | | 2.63 | | | | | 1.19 | | | 2.58 | | 1.16 |
| BDL52 | 7863.2 | P | | | | | | | | | | | | | | | | | |
| BDL52 | 7863.2 | Av. | | | | | | | | | | | | | | | | | |
| BDL52 | 7864.5 | P | | 0.16 | | | | | | | | | | | | | | 0.63 | 0.62 |
| BDL52 | 7864.5 | Av. | | 1.12 | | | | | | | | | | | | | | 1.30 | 1.14 |
| BDL54 | 7781.1 | P | | | | | 0.51 | | | | | | | | 0.51 | | | | 0.51 |
| BDL54 | 7781.1 | Av. | | | | | 4.05 | | | | | | | | 3.55 | | | | 2.68 |
| BDL54 | 7781.4 | P | | | | 0.18 | | | | | | | | 0.29 | | | | 0.72 | |
| BDL54 | 7781.4 | Av. | | | | 1.67 | | | | | | | | 1.57 | | | | 1.15 | |

TABLE 26-continued

| Gene | Ev. | Par. | 18 | 19 | 20 | 21 | 22 | 23 | 24 | 25 | 26 | 27 | 28 | 29 | 30 | 31 | 32 | 33 | 34 |
|---|---|---|---|---|---|---|---|---|---|---|---|---|---|---|---|---|---|---|---|
| BDL54 | 7784.3 | P | | | | 0.21 | 0.43 | | | | | | | 0.17 | 0.31 | | | | 0.29 |
| BDL54 | 7784.3 | Av. | | | | 2.32 | 2.78 | | | | | | | 2.05 | 3.64 | | | | 2.55 |
| BDL54 | 7784.5 | P | | | | 0.11 | | | 0.40 | | | | | 0.01 | 0.27 | | 0.35 | | 0.18 |
| BDL54 | 7784.5 | Av. | | | | 1.38 | | | 3.91 | | | | | 1.29 | 1.23 | | 4.08 | | 1.29 |
| BDL54 | 7785.4 | P | | | | 0.00 | | | | | | | | 0.00 | | 0.02 | | | |
| BDL54 | 7785.4 | Av. | | | | 1.70 | | | | | | | | 1.56 | | 1.23 | | | |
| BDL54 | 7781.1 | P | | | | 0.08 | 0.78 | | | | | | | 0.25 | 0.59 | 0.52 | 0.23 | | |
| BDL54 | 7781.1 | Av. | | | | 3.23 | 1.30 | | | | | | | 3.98 | 1.88 | 1.41 | 1.72 | | |
| BDL54 | 7781.4 | P | | | | 0.55 | | | | | | | | 0.54 | | 0.24 | 0.92 | | |
| BDL54 | 7781.4 | Av. | | | | 3.16 | | | | | | | | 3.57 | | 1.52 | 1.12 | | |
| BDL54 | 7784.3 | P | | | | | | | 0.52 | | | | | | | | 0.17 | | |
| BDL54 | 7784.3 | Av. | | | | | | | 1.21 | | | | | | | | 1.51 | | |
| BDL54 | 7785.4 | P | | | | 0.04 | | | 0.53 | | | | | 0.13 | | | 0.11 | 0.34 | |
| BDL54 | 7785.4 | Av. | | | | 6.70 | | | 1.20 | | | | | 10.24 | | | 1.62 | 3.57 | |
| BDL54 | 7785.8 | P | | | | 0.14 | | | 0.37 | | | | | 0.16 | | | 0.33 | 0.00 | |
| BDL54 | 7785.8 | Av. | | | | 6.30 | | | 1.51 | | | | | 8.24 | | | 1.48 | 3.47 | |
| BDL56 | 7181.2 | P | | | | 0.15 | 0.21 | 0.73 | 0.52 | | | | | 0.14 | 0.26 | 0.66 | 0.50 | | 0.46 |
| BDL56 | 7181.2 | Av. | | | | 1.26 | 1.91 | 1.41 | 2.39 | | | | | 1.44 | 2.65 | 1.64 | 3.57 | | 2.09 |
| BDL56 | 8301.1 | P | 0.00 | 0.05 | 0.11 | | | | 0.55 | 0.32 | 0.01 | 0.03 | | | | | 0.66 | | |
| BDL56 | 8301.1 | Av. | 1.28 | 1.27 | 1.22 | | | | 1.82 | 1.13 | 1.04 | 1.03 | | | | | 1.45 | | |
| BDL56 | 8301.3 | P | | | | | | | 0.40 | | | | | | 0.81 | | 0.35 | | 0.75 |
| BDL56 | 8301.3 | Av. | | | | | | | 2.62 | | | | | | 1.11 | | 2.83 | | 1.15 |
| BDL56 | 8304.1 | P | | 0.38 | | | | | | | | | | | | | | | |
| BDL56 | 8304.1 | Av. | | 1.11 | | | | | | | | | | | | | | | |
| BDL56 | 8305.1 | P | | | | 0.38 | | | 0.43 | | | | | 0.07 | | | 0.46 | 0.79 | |
| BDL56 | 8305.1 | Av. | | | | 1.19 | | | 1.52 | | | | | 1.17 | | | 1.58 | 1.12 | |
| BDL56 | 8301.1 | P | | | | | | 0.29 | | | | | | | | 0.00 | | | |
| BDL56 | 8301.1 | Av. | | | | | | 1.27 | | | | | | | | 1.63 | | | |
| BDL56 | 8301.2 | P | | | | | | | | | | | | | | | | | 0.77 |
| BDL56 | 8301.2 | Av. | | | | | | | | | | | | | | | | | 1.68 |
| BDL56 | 8301.3 | P | 0.54 | | | 0.95 | | | | | | | | 0.91 | | | 0.84 | 0.36 | |
| BDL56 | 8301.3 | Av. | 1.25 | | | 1.36 | | | | | | | | 1.62 | | | 1.11 | 1.80 | |
| BDL56 | 8303.1 | P | | | | | | | | | | | | | | | | | |
| BDL56 | 8303.1 | Av. | | | | | | | | | | | | | | | | | |
| BDL56 | 8303.2 | P | 0.53 | | | 0.01 | | | | | 0.33 | | | 0.00 | | 0.08 | 0.51 | 0.12 | |
| BDL56 | 8303.2 | Av. | 1.11 | | | 6.56 | | | | | 1.13 | | | 9.42 | | 1.25 | 1.22 | 5.45 | |
| BDL59 | 7792.1 | P | | | | | | | 0.39 | 0.07 | | | | | | | 0.50 | | |
| BDL59 | 7792.1 | Av. | | | | | | | 1.69 | 1.08 | | | | | | | 1.58 | | |
| BDL59 | 7792.2 | P | | | | | | | 0.69 | | | | | | | | 0.68 | | |
| BDL59 | 7792.2 | Av. | | | | | | | 2.56 | | | | | | | | 2.78 | | |
| BDL59 | 7792.3 | P | 0.16 | | | | | | | | 0.05 | | | | | | | | |
| BDL59 | 7792.3 | Av. | 1.17 | | | | | | | | 1.03 | | | | | | | | |
| BDL59 | 7793.3 | P | | | | 0.64 | | | 0.83 | | | | | 0.57 | | | 0.73 | 0.36 | |
| BDL59 | 7793.3 | Av. | | | | 1.21 | | | 1.15 | | | | | 1.26 | | | 1.24 | 1.35 | |
| BDL59 | 7794.1 | P | | | | | 0.27 | | 0.86 | | | | | | 0.17 | | 0.81 | | 0.00 |
| BDL59 | 7794.1 | Av. | | | | | 2.60 | | 1.13 | | | | | | 3.67 | | 1.18 | | 3.34 |
| BDL60 | 8011.4 | P | 0.45 | 0.45 | | | | | | | | | | | | | | | |
| BDL60 | 8011.4 | Av. | 1.13 | 1.12 | | | | | | | | | | | | | | | |
| BDL60 | 8011.7 | P | | | | 0.00 | 0.48 | | | | | | | 0.01 | 0.44 | 0.41 | | | 0.45 |
| BDL60 | 8011.7 | Av. | | | | 2.02 | 2.83 | | | | | | | 1.98 | 3.86 | 1.35 | | | 2.63 |
| BDL60 | 8013.4 | P | | | | 0.08 | | | 0.40 | | | | | 0.01 | | 0.05 | 0.27 | | |
| BDL60 | 8013.4 | Av. | | | | 2.96 | | | 2.37 | | | | | 2.30 | | 1.57 | 3.52 | | |
| BDL60 | 8013.6 | P | | | | 0.21 | | | 0.49 | | | | | 0.00 | 0.70 | 0.04 | 0.47 | | 0.26 |
| BDL60 | 8013.6 | Av. | | | | 1.96 | | | 6.84 | | | | | 1.85 | 1.11 | 1.20 | 8.09 | | 1.42 |
| BDL60 | 8014.5 | P | | | | 0.36 | | | 0.90 | | | | | 0.23 | 0.62 | 0.76 | 0.70 | | |
| BDL60 | 8014.5 | Av. | | | | 2.07 | | | 1.16 | | | | | 1.84 | 1.19 | 1.29 | 1.76 | | |
| BDL60 | 8013.6 | P | | | | 0.01 | 0.34 | 0.32 | 0.21 | | | | | 0.00 | 0.04 | 0.19 | 0.09 | 0.77 | 0.89 |
| BDL60 | 8013.6 | Av. | | | | 6.90 | 1.59 | 1.30 | 2.17 | | | | | 8.76 | 1.88 | 1.59 | 2.45 | 1.23 | 1.17 |
| BDL60 | 8014.2 | P | | | | | 0.04 | 0.18 | 0.01 | | | | | | 0.00 | 0.16 | 0.00 | | |
| BDL60 | 8014.2 | Av. | | | | | 1.58 | 1.50 | 2.12 | | | | | | 2.04 | 2.11 | 3.09 | | |
| BDL60 | 8014.7 | P | | | | | | | 0.56 | 0.43 | | | | | 0.42 | 0.45 | 0.50 | | |
| BDL60 | 8014.7 | Av. | | | | | | | 1.55 | 1.26 | | | | | 1.23 | 1.29 | 2.00 | | |
| BDL60 | 8014.8 | P | 0.81 | | | 0.12 | | 0.16 | 0.66 | | | | | 0.17 | | 0.25 | 0.24 | 0.41 | |
| BDL60 | 8014.8 | Av. | 1.12 | | | 7.59 | | 1.18 | 1.14 | | | | | 9.76 | | 1.41 | 1.39 | 4.18 | |
| BDL65 | 7824.1 | P | | | | 0.57 | 0.36 | | 0.65 | | | | | 0.41 | 0.01 | 0.55 | 0.47 | | 0.03 |
| BDL65 | 7824.1 | Av. | | | | 1.51 | 1.24 | | 1.37 | | | | | 1.51 | 1.72 | 1.21 | 2.26 | | 1.36 |
| BDL65 | 7825.2 | P | | | | | 0.40 | 0.49 | 0.11 | | | | | | 0.17 | 0.21 | 0.15 | | |
| BDL65 | 7825.2 | Av. | | | | | 1.29 | 1.18 | 1.76 | | | | | | 1.49 | 1.45 | 2.51 | | |
| BDL65 | 8473.2 | P | | | | 0.13 | 0.20 | 0.07 | 0.51 | | | | | 0.01 | 0.05 | 0.00 | 0.42 | | 0.13 |
| BDL65 | 8473.2 | Av. | | | | 3.11 | 1.16 | 1.31 | 2.00 | | | | | 2.17 | 1.78 | 1.82 | 2.80 | | 1.34 |
| BDL65 | 8474.1 | P | | | | | | 0.13 | 0.22 | | | | | | | 0.05 | 0.33 | 0.64 | |
| BDL65 | 8474.1 | Av. | | | | | | 1.25 | 1.78 | | | | | | | 1.28 | 2.01 | 1.12 | |
| BDL67 | 7901.5 | P | | | | 0.38 | 0.26 | 0.15 | 0.17 | | | | | 0.36 | 0.18 | 0.23 | 0.12 | | |
| BDL67 | 7901.5 | Av. | | | | 1.56 | 1.22 | 1.29 | 1.92 | | | | | 1.46 | 1.34 | 1.48 | 2.49 | | |
| BDL67 | 7902.3 | P | | | 0.46 | 0.65 | 0.47 | | | | | | | 0.68 | 0.48 | | | | 0.49 |
| BDL67 | 7902.3 | Av. | | | 1.12 | 1.11 | 2.65 | | | | | | | 1.11 | 3.06 | | | | 2.43 |
| BDL67 | 7902.7 | P | | | | 0.19 | 0.54 | | | | | | | 0.20 | 0.51 | 0.66 | | | 0.55 |
| BDL67 | 7902.7 | Av. | | | | 1.49 | 1.94 | | | | | | | 1.46 | 2.91 | 1.15 | | | 2.69 |

TABLE 26-continued

| Gene | Ev. | Par. | 18 | 19 | 20 | 21 | 22 | 23 | 24 | 25 | 26 | 27 | 28 | 29 | 30 | 31 | 32 | 33 | 34 |
|---|---|---|---|---|---|---|---|---|---|---|---|---|---|---|---|---|---|---|---|
| BDL67 | 7903.3 | P | | | | 0.68 | | | 0.73 | | | | | 0.71 | | | 0.68 | | |
| BDL67 | 7903.3 | Av. | | | | 1.19 | | | 1.99 | | | | | 1.17 | | | 2.50 | | |
| BDL67 | 7903.5 | P | | | | 0.12 | | | 0.54 | | | | | 0.00 | 0.00 | 0.05 | 0.49 | | 0.04 |
| BDL67 | 7903.5 | Av. | | | | 2.41 | | | 2.43 | | | | | 2.03 | 1.41 | 1.33 | 2.85 | | 1.26 |
| BDL68 | 7761.3 | P | | | | 0.59 | | | 0.74 | | | | | 0.59 | | 0.66 | 0.72 | | |
| BDL68 | 7761.3 | Av. | | | | 1.42 | | | 1.55 | | | | | 1.32 | | 1.17 | 1.60 | | |
| BDL68 | 7761.8 | P | | | | 0.45 | | | 0.21 | | | | | 0.23 | 0.00 | 0.29 | 0.04 | | 0.09 |
| BDL68 | 7761.8 | Av. | | | | 7.80 | | | 1.77 | | | | | 2.62 | 2.04 | 1.30 | 2.56 | | 2.02 |
| BDL68 | 7761.9 | P | | | | | | | | | | | | | 0.39 | 0.64 | 0.96 | | 0.63 |
| BDL68 | 7761.9 | Av. | | | | | | | | | | | | | 1.60 | 1.67 | 1.12 | | 1.41 |
| BDL68 | 7763.2 | P | | | | 0.24 | | | 0.30 | | | | | 0.19 | | | 0.14 | 0.46 | |
| BDL68 | 7763.2 | Av. | | | | 2.08 | | | 1.62 | | | | | 1.91 | | | 1.99 | 1.28 | |
| BDL68 | 7764.1 | P | | | | 0.42 | 0.54 | | 0.83 | | | | | 0.13 | 0.46 | 0.53 | 0.45 | | 0.40 |
| BDL68 | 7764.1 | Av. | | | | 9.83 | 2.45 | | 1.14 | | | | | 2.76 | 3.43 | 1.26 | 1.50 | | 2.71 |
| BDL78 | 7911.11 | P | | | | | | 0.40 | | | | | | 0.08 | 0.56 | 0.14 | | 0.00 | |
| BDL78 | 7911.11 | Av. | | | | | | 1.11 | | | | | | 1.16 | 1.14 | 1.21 | | 1.24 | |
| BDL78 | 7911.8 | P | | | | | | | 0.63 | | | | | 0.15 | 0.57 | | 0.60 | 0.36 | |
| BDL78 | 7911.8 | Av. | | | | | | | 1.79 | | | | | 1.21 | 1.22 | | 2.17 | 1.30 | |
| BDL78 | 7911.9 | P | | | | 0.20 | | | | | | | | 0.00 | 0.14 | 0.00 | 0.69 | | 0.00 |
| BDL78 | 7911.9 | Av. | | | | 6.36 | | | | | | | | 2.58 | 1.94 | 1.88 | 1.25 | | 1.48 |
| BDL78 | 7912.6 | P | | | | | | 0.70 | | | | | | | 0.61 | 0.63 | | | 0.37 |
| BDL78 | 7912.6 | Av. | | | | | | 1.21 | | | | | | | 1.14 | 1.28 | | | 1.16 |
| BDL78 | 7913.11 | P | | | | 0.24 | | 0.66 | | | | | | 0.05 | 0.32 | 0.24 | | 0.13 | 0.67 |
| BDL78 | 7913.11 | Av. | | | | 1.72 | | 1.13 | | | | | | 1.84 | 1.18 | 1.50 | | 1.60 | 1.11 |
| BDL78 | 7913.3 | P | | | | | | 0.53 | | | | | | | | 0.44 | | 0.00 | |
| BDL78 | 7913.3 | Av. | | | | | | 1.14 | | | | | | | | 1.20 | | 1.31 | |
| BDL78 | 7913.6 | P | | | | 0.45 | 0.25 | 0.49 | 0.68 | | | | | 0.18 | 0.12 | 0.06 | 0.24 | 0.49 | 0.42 |
| BDL78 | 7913.6 | Av. | | | | 8.48 | 1.13 | 1.22 | 1.23 | | | | | 2.37 | 1.90 | 1.81 | 1.92 | 1.16 | 1.44 |
| BDL78 | 7913.8 | P | | | | | 0.31 | 0.21 | 0.68 | | | | | 0.04 | 0.23 | 0.10 | 0.53 | 0.07 | 0.48 |
| BDL78 | 7913.8 | Av. | | | | | 1.36 | 1.28 | 1.29 | | | | | 1.30 | 1.69 | 1.58 | 1.69 | 1.14 | 1.11 |
| BDL78 | 7913.9 | P | | | | 0.51 | | 0.52 | 0.20 | | | | | 0.34 | 0.49 | 0.46 | 0.15 | 0.07 | |
| BDL78 | 7913.9 | Av. | | | | 1.37 | | 1.14 | 1.41 | | | | | 1.48 | 1.25 | 1.28 | 1.50 | 1.53 | |
| BDL82 | 7801.1 | P | | | | 0.20 | 0.00 | 0.24 | 0.34 | | | | | 0.00 | 0.00 | 0.12 | 0.25 | | |
| BDL82 | 7801.1 | Av. | | | | 2.67 | 1.39 | 1.66 | 2.12 | | | | | 2.04 | 1.80 | 2.22 | 3.05 | | |
| BDL82 | 7801.3 | P | | | | 0.33 | | | 0.83 | | | | | 0.03 | 0.03 | | 0.14 | | |
| BDL82 | 7801.3 | Av. | | | | 8.14 | | | 1.12 | | | | | 2.90 | 1.28 | | 2.08 | | |
| BDL82 | 7802.2 | P | | | | 0.18 | | | 0.44 | | | | | 0.14 | 0.77 | 0.01 | 0.41 | 0.09 | |
| BDL82 | 7802.2 | Av. | | | | 2.55 | | | 5.01 | | | | | 2.16 | 1.11 | 1.26 | 6.53 | 1.35 | |
| BDL82 | 7802.3 | P | | | | 0.16 | 0.67 | 0.00 | 0.43 | | | | | 0.08 | 0.48 | 0.21 | 0.06 | | |
| BDL82 | 7802.3 | Av. | | | | 2.36 | 1.21 | 1.20 | 1.58 | | | | | 2.03 | 1.70 | 1.72 | 2.45 | | |
| BDL82 | 7803.9 | P | 0.24 | 0.01 | 0.37 | | | | | 0.00 | | 0.00 | | | | | | | 0.46 |
| BDL82 | 7803.9 | Av. | 1.15 | 1.30 | 1.18 | | | | | 1.14 | | 1.04 | | | | | | | 1.28 |
| BDL89 | 7812.2 | P | | | | 0.49 | | | | | | | | 0.67 | | | | | 0.34 |
| BDL89 | 7812.2 | Av. | | | | 1.15 | | | | | | | | 1.14 | | | | | 1.11 |
| BDL89 | 7812.5 | P | | | | | 0.44 | 0.55 | 0.26 | | | | | | 0.45 | 0.46 | 0.29 | | 0.49 |
| BDL89 | 7812.5 | Av. | | | | | 3.98 | 1.46 | 7.37 | | | | | | 3.87 | 1.49 | 7.29 | | 2.55 |
| BDL89 | 7814.1 | P | | | | 0.03 | 0.20 | 0.29 | 0.44 | | | | | 0.42 | 0.49 | 0.45 | 0.43 | | 0.77 |
| BDL89 | 7814.1 | Av. | | | | 1.22 | 1.11 | 1.17 | 2.98 | | | | | 1.12 | 1.12 | 1.14 | 2.97 | | 1.11 |
| BDL89 | 7814.4 | P | | | | 0.51 | 0.42 | 0.00 | 0.44 | | | | | 0.51 | 0.39 | 0.15 | 0.10 | | 0.33 |
| BDL89 | 7814.4 | Av. | | | | 3.96 | 2.15 | 1.23 | 1.63 | | | | | 1.94 | 3.04 | 1.58 | 2.16 | | 1.96 |
| BDL89 | 7814.5 | P | | | | 0.42 | | 0.55 | 0.43 | | | | | 0.31 | 0.20 | 0.42 | 0.19 | 0.32 | 0.13 |
| BDL89 | 7814.5 | Av. | | | | 3.45 | | 1.14 | 1.67 | | | | | 2.25 | 1.16 | 1.45 | 2.21 | 1.39 | 1.12 |

Table 26.

TABLE 27

| Gene | Ev. | Par. | 35 | 36 | 37 | 38 | 39 | 40 | 41 | 42 | 43 | 44 | 45 |
|---|---|---|---|---|---|---|---|---|---|---|---|---|---|
| BDL95 | 7841.5 | P | | 0.67 | | 0.70 | 0.74 | | 0.55 | | 0.14 | | 0.74 |
| BDL95 | 7841.5 | Av. | | 1.64 | | 1.36 | 1.22 | | 1.11 | | 1.18 | | 1.22 |
| BDL95 | 7842.12 | P | | | | | | | | | 0.77 | 0.03 | |
| BDL95 | 7842.12 | Av. | | | | | | | | | 1.12 | 1.19 | |
| BDL95 | 7842.2 | P | | | 0.71 | | | | | | 0.58 | | |
| BDL95 | 7842.2 | Av. | | | 1.14 | | | | | | 1.11 | | |
| BDL95 | 7842.8 | P | 0.28 | | 0.58 | 0.78 | | | 0.01 | | 0.00 | | |
| BDL95 | 7842.8 | Av. | 1.18 | | 1.14 | 1.11 | | | 1.21 | | 1.29 | | |
| BDL95 | 7843.4 | P | | | 0.49 | | | 0.49 | | | 0.49 | | |
| BDL95 | 7843.4 | Av. | | | 10.16 | | | 5.89 | | | 9.51 | | |
| BDL100 | 7871.2 | P | 0.39 | | 0.36 | | | 0.37 | | | 0.08 | 0.21 | |
| BDL100 | 7871.2 | Av. | 1.13 | | 1.25 | | | 1.14 | | | 1.25 | 1.15 | |
| BDL100 | 7872.2 | P | | 0.03 | 0.29 | 0.46 | | 0.26 | | | 0.32 | 0.09 | |
| BDL100 | 7872.2 | Av. | | 1.40 | 1.25 | 1.40 | | 1.20 | | | 1.40 | 1.20 | |
| BDL100 | 7872.3 | P | | | 0.01 | | | | | | | | |
| BDL100 | 7872.3 | Av. | | | 1.49 | | | | | | | | |
| BDL100 | 7873.3 | P | | | | | | 0.42 | 0.03 | | | 0.02 | |

TABLE 27-continued

| | | | | | | | | | | | | | |
|---|---|---|---|---|---|---|---|---|---|---|---|---|---|
| BDL100 | 7873.3 | Av. | | | | | | 1.18 | 1.16 | | | 1.23 | |
| BDL100 | 7873.4 | P | | | 0.50 | 0.01 | | 0.43 | | | | | |
| BDL100 | 7873.4 | Av. | | | 2.93 | 1.37 | | 2.58 | | | | | |
| BDL106 | 7881.1 | P | | 0.01 | | 0.50 | 0.00 | | | | | | 0.00 |
| BDL106 | 7881.1 | Av. | | 1.41 | | 1.39 | 1.40 | | | | | | 1.40 |
| BDL106 | 7881.4 | P | | 0.47 | | 0.06 | 0.68 | | | | | | 0.68 |
| BDL106 | 7881.4 | Av. | | 8.12 | | 1.69 | 1.12 | | | | | | 1.12 |
| BDL106 | 7882.6 | P | | 0.63 | | 0.25 | | 0.04 | | | | | |
| BDL106 | 7882.6 | Av. | | 1.42 | | 1.19 | | 1.15 | | | | | |
| BDL106 | 7884.1 | P | | | 0.49 | | | 0.50 | | | 0.51 | 0.16 | |
| BDL106 | 7884.1 | Av. | | | 12.26 | | | 5.79 | | | 4.04 | 1.36 | |
| BDL106 | 7884.9 | P | | 0.54 | | 0.31 | 0.69 | | 0.47 | | 0.62 | 0.24 | 0.69 |
| BDL106 | 7884.9 | Av. | | 3.90 | | 2.59 | 1.32 | | 1.13 | | 1.12 | 1.19 | 1.32 |
| BDL106 | 7881.1 | P | 0.44 | 0.00 | 0.46 | | 0.01 | | 0.23 | | | 0.21 | 0.01 |
| BDL106 | 7881.1 | Av. | 1.19 | 1.37 | 1.49 | | 1.15 | | 1.16 | | | 1.21 | 1.15 |
| BDL106 | 7881.2 | P | | | 0.74 | 0.29 | 0.40 | | | | 0.62 | | 0.40 |
| BDL106 | 7881.2 | Av. | | | 1.17 | 1.69 | 1.16 | | | | 1.21 | | 1.16 |
| BDL106 | 7882.2 | P | | | 0.11 | 0.73 | | | | | | | |
| BDL106 | 7882.2 | Av. | | | 1.30 | 1.54 | | | | | | | |
| BDL106 | 7882.4 | P | | | | 0.08 | | | 0.24 | | 0.60 | 0.09 | |
| BDL106 | 7882.4 | Av. | | | | 2.00 | | | 1.12 | | 1.22 | 1.25 | |
| BDL106 | 7882.5 | P | | | 0.14 | 0.44 | | | 0.43 | 0.26 | 0.06 | 0.03 | |
| BDL106 | 7882.5 | Av. | | | 1.30 | 1.72 | | | 1.21 | 1.12 | 1.39 | 1.16 | |
| BDL108 | 8122.2 | P | 0.05 | 0.62 | 0.48 | 0.58 | | 0.49 | 0.39 | | 0.48 | 0.25 | |
| BDL108 | 8122.2 | Av. | 1.15 | 3.47 | 4.92 | 1.26 | | 4.63 | 1.16 | | 2.58 | 1.40 | |
| BDL108 | 8122.3 | P | | 0.42 | | 0.53 | 0.44 | | 0.31 | | 0.44 | 0.05 | 0.44 |
| BDL108 | 8122.3 | Av. | | 4.07 | | 1.46 | 1.37 | | 1.13 | | 1.22 | 1.17 | 1.37 |
| BDL108 | 8123.1 | P | | 0.14 | | 0.78 | 0.03 | | | 0.37 | 0.40 | | 0.03 |
| BDL108 | 8123.1 | Av. | | 3.19 | | 1.13 | 1.93 | | | 1.25 | 1.22 | | 1.93 |
| BDL108 | 8123.2 | P | | 0.59 | 0.51 | 0.39 | 0.71 | 0.52 | 0.50 | | 0.54 | 0.38 | 0.71 |
| BDL108 | 8123.2 | Av. | | 6.61 | 11.57 | 2.13 | 2.17 | 6.48 | 1.30 | | 3.24 | 1.56 | 2.17 |
| BDL108 | 8123.5 | P | | 0.45 | | 0.22 | 0.47 | | 0.13 | | | 0.43 | 0.47 |
| BDL108 | 8123.5 | Av. | | 4.40 | | 1.30 | 1.34 | | 1.11 | | | 1.30 | 1.34 |
| BDL108 | 8121.1 | P | | | | 0.21 | | | | | | | |
| BDL108 | 8121.1 | Av. | | | | 3.08 | | | | | | | |
| BDL108 | 8121.3 | P | | | | 0.01 | | | | | | | |
| BDL108 | 8121.3 | Av. | | | | 1.65 | | | | | | | |
| BDL108 | 8121.4 | P | | 0.76 | | 0.06 | | | | | | | |
| BDL108 | 8121.4 | Av. | | 1.23 | | 1.44 | | | | | | | |
| BDL108 | 8122.7 | P | | | | 0.02 | | | | | | | |
| BDL108 | 8122.7 | Av. | | | | 1.90 | | | | | | | |
| BDL108 | 8123.7 | P | | 0.48 | 0.34 | 0.09 | | | | | 0.74 | 0.00 | |
| BDL108 | 8123.7 | Av. | | 1.21 | 1.15 | 1.58 | | | | | 1.11 | 1.21 | |
| BDL110 | 8092.1 | P | | | | 0.24 | | | | | | | |
| BDL110 | 8092.1 | Av. | | | | 1.18 | | | | | | | |
| BDL110 | 8092.2 | P | | | | 0.11 | | | 0.01 | | | 0.01 | |
| BDL110 | 8092.2 | Av. | | | | 1.75 | | | 1.20 | | | 1.24 | |
| BDL110 | 8092.5 | P | | | | 0.27 | | | 0.04 | | | | |
| BDL110 | 8092.5 | Av. | | | | 1.17 | | | 1.09 | | | | |
| BDL110 | 8095.2 | P | | | | | | | | | | 0.61 | |
| BDL110 | 8095.2 | Av. | | | | | | | | | | 1.11 | |
| BDL111 | 8102.7 | P | | 0.24 | 0.54 | 0.14 | | 0.04 | | | 0.02 | 0.21 | |
| BDL111 | 8102.7 | Av. | | 1.33 | 1.24 | 1.81 | | 1.24 | | | 1.30 | 1.13 | |
| BDL111 | 8103.1 | P | | 0.68 | 0.09 | 0.04 | | 0.20 | | | 0.00 | 0.07 | |
| BDL111 | 8103.1 | Av. | | 1.37 | 1.70 | 1.77 | | 1.54 | | | 1.37 | 1.15 | |
| BDL111 | 8103.2 | P | | 0.26 | | | 0.72 | | | 0.76 | | | 0.72 |
| BDL111 | 8103.2 | Av. | | 2.29 | | | 1.13 | | | 1.14 | | | 1.13 |
| BDL111 | 8103.4 | P | | 0.52 | 0.53 | 0.08 | | | | | 0.47 | | |
| BDL111 | 8103.4 | Av. | | 2.01 | 1.22 | 1.81 | | | | | 1.19 | | |
| BDL111 | 8103.5 | P | | 0.25 | 0.40 | 0.17 | 0.67 | 0.64 | 0.27 | | | 0.03 | 0.67 |
| BDL111 | 8103.5 | Av. | | 1.87 | 1.19 | 1.71 | 1.20 | 1.12 | 1.13 | | | 1.20 | 1.20 |
| BDL111 | 8102.7 | P | | 0.31 | | 0.52 | | | 0.44 | | | 0.27 | |
| BDL111 | 8102.7 | Av. | | 1.32 | | 1.29 | | | 1.12 | | | 1.23 | |
| BDL111 | 8103.1 | P | | | | 0.45 | | | 0.24 | | 0.00 | | |
| BDL111 | 8103.1 | Av. | | | | 1.24 | | | 1.12 | | 1.31 | | |
| BDL111 | 8103.2 | P | | 0.61 | | 0.51 | | | | | 0.33 | 0.25 | |
| BDL111 | 8103.2 | Av. | | 1.93 | | 1.80 | | | | | 1.25 | 1.22 | |
| BDL111 | 8103.4 | P | | | | 0.15 | | | | | 0.25 | 0.40 | |
| BDL111 | 8103.4 | Av. | | | | 1.66 | | | | | 1.18 | 1.17 | |
| BDL111 | 8103.5 | P | | 0.15 | | 0.34 | | | 0.10 | | | | |
| BDL111 | 8103.5 | Av. | | 1.80 | | 1.72 | | | 1.11 | | | | |
| BDL112 | 7502.1 | P | | | | | | 0.07 | | | 0.38 | 0.09 | |
| BDL112 | 7502.1 | Av. | | | | | | 1.30 | | | 1.22 | 1.14 | |
| BDL112 | 7502.14 | P | | | 0.50 | | | 0.49 | | | 0.49 | | |
| BDL112 | 7502.14 | Av. | | | 9.53 | | | 4.98 | | | 9.33 | | |
| BDL112 | 7502.4 | P | | 0.40 | 0.33 | 0.02 | 0.65 | 0.48 | | | 0.00 | 0.03 | 0.65 |
| BDL112 | 7502.4 | Av. | | 2.81 | 1.20 | 1.35 | 1.37 | 1.31 | | | 1.23 | 1.19 | 1.37 |
| BDL112 | 7502.7 | P | | 0.26 | | 0.31 | | 0.45 | | | 0.00 | 0.20 | |
| BDL112 | 7502.7 | Av. | | 2.00 | | 1.76 | | 1.21 | | | 1.22 | 1.15 | |
| BDL112 | 7502.9 | P | | | 0.59 | | | 0.48 | | | 0.28 | 0.15 | |

TABLE 27-continued

| | | | | | | | | | | | | | |
|---|---|---|---|---|---|---|---|---|---|---|---|---|---|
| BDL112 | 7502.9 | Av. | | | 1.14 | | | 1.29 | | | 1.15 | 1.11 | |
| BDL112 | 7502.1 | P | | 0.31 | | 0.39 | | | 0.03 | | 0.04 | 0.02 | |
| BDL112 | 7502.1 | Av. | | 2.00 | | 1.38 | | | 1.11 | | 1.38 | 1.26 | |
| BDL112 | 7502.4 | P | 0.01 | | 0.22 | | 0.01 | | 0.02 | | 0.26 | 0.43 | 0.01 |
| BDL112 | 7502.4 | Av. | 1.26 | | 1.85 | | 1.15 | | 1.13 | | 1.29 | 1.19 | 1.15 |
| BDL112 | 7502.7 | P | 0.25 | 0.11 | 0.20 | | 0.41 | | 0.00 | | 0.25 | 0.57 | 0.41 |
| BDL112 | 7502.7 | Av. | 1.28 | 1.50 | 1.20 | | 1.11 | | 1.23 | | 1.30 | 1.10 | 1.11 |
| BDL112 | 7502.8 | P | 0.38 | 0.49 | 0.58 | | 0.01 | | 0.01 | 0.07 | 0.15 | 0.01 | 0.01 |
| BDL112 | 7502.8 | Av. | 1.21 | 1.64 | 1.17 | | 1.14 | | 1.15 | 1.16 | 1.21 | 1.25 | 1.14 |
| BDL112 | 7502.9 | P | | 0.06 | | 0.07 | | | 0.11 | | 0.00 | | |
| BDL112 | 7502.9 | Av. | | 1.22 | | 1.63 | | | 1.12 | | 1.34 | | |
| BDL113 | 7683.4 | P | | 0.29 | | 0.06 | 0.28 | | 0.01 | | 0.02 | 0.07 | 0.28 |
| BDL113 | 7683.4 | Av. | | 2.64 | | 2.49 | 1.88 | | 1.23 | | 1.11 | 1.15 | 1.88 |
| BDL113 | 7683.6 | P | | 0.30 | 0.24 | 0.00 | | 0.03 | | | | 0.33 | |
| BDL113 | 7683.6 | Av. | | 2.33 | 1.40 | 1.67 | | 1.47 | | | | 1.21 | |
| BDL113 | 7684.3 | P | | 0.68 | 0.14 | 0.00 | | | | | | | |
| BDL113 | 7684.3 | Av. | | 1.42 | 1.21 | 1.92 | | | | | | | |
| BDL113 | 7684.6 | P | | 0.25 | | 0.21 | 0.70 | | 0.51 | | | 0.37 | 0.70 |
| BDL113 | 7684.6 | Av. | | 2.21 | | 1.55 | 1.20 | | 1.12 | | | 1.10 | 1.20 |
| BDL113 | 7684.7 | P | | | | 0.02 | | | | | | 0.32 | |
| BDL113 | 7684.7 | Av. | | | | 1.67 | | | | | | 1.15 | |
| BDL113 | 7683.1 | P | | 0.05 | | 0.43 | | 0.54 | | | 0.41 | 0.01 | |
| BDL113 | 7683.1 | Av. | | 1.39 | | 1.62 | | 1.15 | | | 1.20 | 1.20 | |
| BDL113 | 7683.11 | P | | | | | | | | | | | |
| BDL113 | 7683.11 | Av. | | | | | | | | | | | |
| BDL113 | 7683.4 | P | | 0.72 | | 0.77 | | 0.69 | | | 0.39 | 0.00 | |
| BDL113 | 7683.4 | Av. | | 1.33 | | 1.21 | | 1.12 | | | 1.14 | 1.24 | |
| BDL113 | 7684.1 | P | | | | | | | | | | | |
| BDL113 | 7684.1 | Av. | | | | | | | | | | | |
| BDL113 | 7684.5 | P | | | | | | | | | | | |
| BDL113 | 7684.5 | Av. | | | | | | | | | | | |
| BDL114 | 7741.3 | P | | | 0.50 | 0.00 | | 0.50 | 0.10 | | 0.49 | 0.33 | |
| BDL114 | 7741.3 | Av. | | | 24.74 | 1.73 | | 10.33 | 1.14 | | 6.56 | 1.14 | |
| BDL114 | 7741.6 | P | | | 0.50 | | | 0.49 | | | 0.50 | | |
| BDL114 | 7741.6 | Av. | | | 65.41 | | | 11.28 | | | 9.24 | | |
| BDL114 | 7742.1 | P | | 0.50 | | | | 0.39 | | | 0.01 | 0.20 | |
| BDL114 | 7742.1 | Av. | | 1.51 | | | | 1.22 | | | 1.16 | 1.11 | |
| BDL114 | 7742.3 | P | | 0.48 | 0.00 | | | 0.03 | | | 0.15 | | |
| BDL114 | 7742.3 | Av. | | 6.61 | 1.94 | | | 1.69 | | | 1.30 | | |
| BDL114 | 7742.5 | P | | 0.22 | 0.29 | 0.02 | | 0.45 | 0.17 | | 0.02 | 0.34 | |
| BDL114 | 7742.5 | Av. | | 3.37 | 1.93 | 2.22 | | 1.58 | 1.14 | | 1.57 | 1.32 | |
| BDL115 | 8152.3 | P | | 0.27 | | | | | | | | | |
| BDL115 | 8152.3 | Av. | | 1.28 | | | | | | | | | |
| BDL115 | 8152.4 | P | | 0.05 | | 0.00 | 0.02 | | 0.07 | | | | 0.02 |
| BDL115 | 8152.4 | Av. | | 1.42 | | 1.67 | 1.58 | | 1.12 | | | | 1.58 |
| BDL115 | 8154.1 | P | | | 0.15 | 0.11 | | 0.40 | | | | 0.22 | |
| BDL115 | 8154.1 | Av. | | | 1.41 | 1.31 | | 1.32 | | | | 1.23 | |
| BDL115 | 8155.2 | P | | | 0.49 | 0.03 | | 0.50 | | | 0.50 | | |
| BDL115 | 8155.2 | Av. | | | 9.95 | 1.32 | | 6.80 | | | 12.32 | | |
| BDL115 | 8155.4 | P | | 0.72 | 0.49 | 0.00 | | 0.51 | | | 0.45 | | |
| BDL115 | 8155.4 | Av. | | 2.26 | 4.22 | 1.60 | | 3.59 | | | 1.83 | | |
| BDL115 | 8152.3 | P | | 0.51 | | 0.24 | | | 0.01 | | 0.12 | 0.33 | |
| BDL115 | 8152.3 | Av. | | 1.56 | | 1.84 | | | 1.27 | | 1.22 | 1.13 | |
| BDL115 | 8152.4 | P | | 0.01 | 0.57 | 0.01 | | 0.25 | 0.08 | | 0.08 | 0.02 | |
| BDL115 | 8152.4 | Av. | | 2.40 | 1.29 | 2.01 | | 1.20 | 1.19 | | 1.63 | 1.25 | |
| BDL115 | 8154.1 | P | | 0.35 | 0.85 | 0.00 | 0.29 | | 0.01 | | 0.40 | 0.42 | 0.29 |
| BDL115 | 8154.1 | Av. | | 1.78 | 1.15 | 2.51 | 1.19 | | 1.16 | | 1.47 | 1.14 | 1.19 |
| BDL115 | 8155.2 | P | | | | 0.11 | | | | | | | |
| BDL115 | 8155.2 | Av. | | | | 1.60 | | | | | | | |
| BDL115 | 8155.4 | P | | | | 0.05 | | | | | | | |
| BDL115 | 8155.4 | Av. | | | | 2.30 | | | | | | | |
| BDL116 | 7481.2 | P | | 0.24 | 0.16 | 0.18 | | 0.12 | | | 0.22 | | |
| BDL116 | 7481.2 | Av. | | 1.61 | 1.19 | 1.16 | | 1.21 | | | 1.17 | | |
| BDL116 | 7481.7 | P | 0.48 | 0.69 | 0.26 | | 0.74 | | 0.44 | | 0.63 | | 0.74 |
| BDL116 | 7481.7 | Av. | 1.11 | 1.11 | 1.44 | | 1.14 | | 1.13 | | 1.11 | | 1.14 |
| BDL116 | 7481.8 | P | | | 0.49 | | | 0.50 | | | 0.49 | 0.33 | |
| BDL116 | 7481.8 | Av. | | | 15.78 | | | 5.33 | | | 13.31 | 1.10 | |
| BDL116 | 7482.2 | P | | 0.45 | | 0.10 | 0.46 | | 0.02 | | | 0.13 | 0.46 |
| BDL116 | 7482.2 | Av. | | 1.23 | | 1.53 | 1.34 | | 1.18 | | | 1.22 | 1.34 |
| BDL116 | 7485.1 | P | | 0.00 | 0.13 | 0.36 | | 0.46 | 0.08 | | 0.55 | 0.20 | |
| BDL116 | 7485.1 | Av. | | 2.03 | 1.35 | 1.47 | | 1.27 | 1.20 | | 1.10 | 1.31 | |
| BDL119 | 7732.2 | P | | 0.09 | | 0.03 | | | 0.09 | | | 0.10 | |
| BDL119 | 7732.2 | Av. | | 2.30 | | 1.61 | | | 1.16 | | | 1.44 | |
| BDL119 | 7733.2 | P | 0.70 | 0.01 | 0.23 | | | 0.06 | | | | 0.27 | |
| BDL119 | 7733.2 | Av. | 1.12 | 1.47 | 1.28 | | | 1.21 | | | | 1.39 | |
| BDL119 | 7734.1 | P | 0.30 | 0.02 | | | | 0.52 | 0.21 | | | 0.15 | |
| BDL119 | 7734.1 | Av. | 1.21 | 1.50 | | | | 1.12 | 1.13 | | | 1.36 | |
| BDL119 | 7734.5 | P | | | 0.39 | | | | | | | | |
| BDL119 | 7734.5 | Av. | | | 1.16 | | | | | | | | |
| BDL119 | 7734.7 | P | | | | | | | | | | | |

TABLE 27-continued

| | | | | | | | | | | | | | |
|---|---|---|---|---|---|---|---|---|---|---|---|---|---|
| BDL119 | 7734.7 | Av. | | | | | | | | | | | |
| BDL120 | 7891.3 | P | | 0.00 | | 0.06 | 0.15 | | 0.02 | | 0.35 | 0.10 | 0.15 |
| BDL120 | 7891.3 | Av. | | 5.30 | | 1.42 | 1.84 | | 1.19 | | 1.30 | 1.13 | 1.84 |
| BDL120 | 7892.4 | P | | 0.36 | 0.01 | | | 0.03 | | | 0.00 | 0.26 | |
| BDL120 | 7892.4 | Av. | | 1.37 | 1.48 | | | 1.28 | | | 1.37 | 1.15 | |
| BDL120 | 7892.6 | P | | | | | | | | | | | |
| BDL120 | 7892.6 | Av. | | | | | | | | | | | |
| BDL120 | 7893.2 | P | 0.65 | | 0.36 | 0.86 | | 0.19 | 0.14 | | | | |
| BDL120 | 7893.2 | Av. | 1.11 | | 22.46 | 1.20 | | 11.26 | 1.13 | | | | |
| BDL120 | 7893.5 | P | | 0.39 | | | 0.22 | | | | | | 0.22 |
| BDL120 | 7893.5 | Av. | | 1.13 | | | 1.19 | | | | | | 1.19 |
| BDL122 | 7513.1 | P | | | | | | | | | | 0.16 | |
| BDL122 | 7513.1 | Av. | | | | | | | | | | 1.20 | |
| BDL122 | 7513.1 | P | 0.17 | 0.48 | | | 0.06 | | | 0.76 | | 0.30 | 0.06 |
| BDL122 | 7513.1 | Av. | 1.12 | 1.90 | | | 1.51 | | | 1.13 | | 1.26 | 1.51 |
| BDL122 | 7513.14 | P | | 0.23 | | | | 0.31 | | | 0.00 | 0.02 | |
| BDL122 | 7513.14 | Av. | | 2.17 | | | | 1.18 | | | 1.27 | 1.30 | |
| BDL122 | 7513.9 | P | | | 0.49 | | | 0.48 | | | 0.45 | | |
| BDL122 | 7513.9 | Av. | | | 5.96 | | | 5.25 | | | 3.93 | | |
| BDL122 | 7514.3 | P | | | 0.53 | | | 0.53 | | | 0.42 | | |
| BDL122 | 7514.3 | Av. | | | 4.10 | | | 4.19 | | | 1.34 | | |
| BDL122 | 7513.1 | P | | | | 0.44 | | | | | | | |
| BDL122 | 7513.1 | Av. | | | | 1.17 | | | | | | | |
| BDL122 | 7513.14 | P | | | 0.36 | 0.42 | 0.04 | | | | | | 0.04 |
| BDL122 | 7513.14 | Av. | | | 1.28 | 1.17 | 1.26 | | | | | | 1.26 |
| BDL122 | 7513.9 | P | | | | | | | | | | | |
| BDL122 | 7513.9 | Av. | | | | | | | | | | | |
| BDL122 | 7514.3 | P | | | | 0.34 | | | | | | | |
| BDL122 | 7514.3 | Av. | | | | 1.73 | | | | | | | |
| BDL123 | 8082.1 | P | | | | | | 0.00 | | | | | |
| BDL123 | 8082.1 | Av. | | | | | | 1.30 | | | | | |
| BDL123 | 8082.3 | P | | | | | | | | | | | |
| BDL123 | 8082.3 | Av. | | | | | | | | | | | |
| BDL123 | 8082.6 | P | | | 0.72 | 0.38 | | 0.68 | | | | 0.08 | |
| BDL123 | 8082.6 | Av. | | | 1.21 | 1.45 | | 1.17 | | | | 1.15 | |
| BDL123 | 8083.2 | P | | | 0.50 | | | 0.50 | | | 0.50 | | |
| BDL123 | 8083.2 | Av. | | | 20.40 | | | 9.06 | | | 17.24 | | |
| BDL123 | 8083.3 | P | | | | | | | | | | | |
| BDL123 | 8083.3 | Av. | | | | | | | | | | | |
| BDL124 | 8482.1 | P | 0.17 | 0.39 | | 0.04 | | | 0.01 | | | 0.09 | |
| BDL124 | 8482.1 | Av. | 1.12 | 2.21 | | 1.35 | | | 1.12 | | | 1.18 | |
| BDL125 | 7491.1 | P | | | | | | | | | | | |
| BDL125 | 7491.1 | Av. | | | | | | | | | | | |
| BDL125 | 7491.5 | P | | | 0.37 | | | 0.05 | | | | | |
| BDL125 | 7491.5 | Av. | | | 1.27 | | | 1.16 | | | | | |
| BDL125 | 7492.5 | P | | 0.43 | | 0.54 | 0.56 | | | | 0.40 | 0.13 | 0.56 |
| BDL125 | 7492.5 | Av. | | 1.72 | | 1.62 | 1.53 | | | | 1.12 | 1.16 | 1.53 |
| BDL125 | 7494.1 | P | | 0.54 | | 0.03 | 0.59 | | 0.20 | | | | 0.59 |
| BDL125 | 7494.1 | Av. | | 1.65 | | 1.65 | 1.21 | | 1.10 | | | | 1.21 |
| BDL125 | 7495.5 | P | | 0.48 | 0.33 | 0.17 | 0.43 | | | | 0.37 | 0.47 | 0.43 |
| BDL125 | 7495.5 | Av. | | 1.41 | 1.28 | 1.75 | 1.50 | | | | 1.14 | 1.24 | 1.50 |
| BDL128 | 7711.3 | P | | 0.55 | 0.79 | 0.59 | 0.82 | 0.85 | 0.53 | | | | 0.82 |
| BDL128 | 7711.3 | Av. | | 1.41 | 1.26 | 1.73 | 1.12 | 1.12 | 1.13 | | | | 1.12 |
| BDL128 | 8361.5 | P | | | 0.50 | 0.64 | | 0.53 | 0.43 | | | 0.36 | |
| BDL128 | 8361.5 | Av. | | | 4.09 | 1.61 | | 3.76 | 1.14 | | | 1.30 | |
| BDL128 | 8362.2 | P | | | | 0.72 | | | | | | | |
| BDL128 | 8362.2 | Av. | | | | 1.15 | | | | | | | |
| BDL128 | 8363.2 | P | | 0.48 | | 0.60 | | | | | | | |
| BDL128 | 8363.2 | Av. | | 2.28 | | 1.46 | | | | | | | |
| BDL128 | 8365.2 | P | | | 0.48 | 0.49 | | 0.48 | | | 0.46 | | |
| BDL128 | 8365.2 | Av. | | | 7.01 | 1.50 | | 5.56 | | | 3.18 | | |
| BDL129 | 7691.4 | P | | | 0.26 | 0.70 | | | | | | | |
| BDL129 | 7691.4 | Av. | | | 1.41 | 1.25 | | | | | | | |
| BDL129 | 7691.6 | P | | 0.25 | 0.04 | 0.34 | | 0.16 | | | 0.02 | | |
| BDL129 | 7691.6 | Av. | | 1.88 | 1.34 | 1.38 | | 1.34 | | | 1.28 | | |
| BDL129 | 7692.2 | P | | | 0.50 | 0.09 | | 0.51 | | | 0.51 | | |
| BDL129 | 7692.2 | Av. | | | 11.03 | 1.77 | | 6.06 | | | 7.47 | | |
| BDL129 | 7692.6 | P | | | 0.06 | 0.68 | | | | | | | |
| BDL129 | 7692.6 | Av. | | | 1.31 | 1.19 | | | | | | | |
| BDL129 | 7693.1 | P | | | 0.50 | | | 0.50 | | | 0.49 | | |
| BDL129 | 7693.1 | Av. | | | 12.70 | | | 6.16 | | | 3.58 | | |
| BDL130 | 7663.1 | P | | | 0.35 | | | 0.08 | | | | 0.66 | |
| BDL130 | 7663.1 | Av. | | | 1.26 | | | 1.14 | | | | 1.15 | |
| BDL130 | 7663.3 | P | | 0.43 | 0.33 | 0.27 | | 0.01 | 0.19 | | 0.03 | 0.05 | |
| BDL130 | 7663.3 | Av. | | 6.12 | 1.67 | 1.82 | | 1.41 | 1.13 | | 1.21 | 1.43 | |
| BDL130 | 7663.6 | P | | | | 0.11 | | | | | | | |
| BDL130 | 7663.6 | Av. | | | | 1.24 | | | | | | | |
| BDL130 | 7664.5 | P | | | | | | | | | | | |
| BDL130 | 7664.5 | Av. | | | | | | | | | | | |
| BDL131 | 7461.2 | P | | | 0.38 | | | 0.00 | | | 0.00 | | |

TABLE 27-continued

| | | | | | | | | | | | | | |
|---|---|---|---|---|---|---|---|---|---|---|---|---|---|
| BDL131 | 7461.2 | Av. | | | 1.16 | | | 1.30 | | | 1.16 | | |
| BDL131 | 7461.4 | P | | | | | | | | | | | |
| BDL131 | 7461.4 | Av. | | | | | | | | | | | |
| BDL131 | 7462.2 | P | | | | | | | | | | | |
| BDL131 | 7462.2 | Av. | | | | | | | | | | | |
| BDL131 | 7463.4 | P | | | 0.41 | | | 0.16 | | | | 0.01 | |
| BDL131 | 7463.4 | Av. | | | 1.26 | | | 1.21 | | | | 1.24 | |
| BDL131 | 7464.5 | P | | | 0.57 | 0.34 | | 0.06 | | | 0.26 | | |
| BDL132 | 7464.5 | Av. | | | 1.13 | 1.57 | | 1.14 | | | 1.25 | | |
| BDL132 | 7471.1 | P | | 0.00 | | 0.43 | 0.05 | | | | | | 0.05 |
| BDL132 | 7471.1 | Av. | | 1.79 | | 1.10 | 1.74 | | | | | | 1.74 |
| BDL132 | 7471.4 | P | | | | | 0.72 | | | | | | 0.72 |
| BDL132 | 7471.4 | Av. | | | | | 1.21 | | | | | | 1.21 |
| BDL132 | 7472.4 | P | | 0.45 | 0.27 | 0.03 | 0.45 | | | | | | 0.45 |
| BDL132 | 7472.4 | Av. | | 1.89 | 1.15 | 1.31 | 1.30 | | | | | | 1.30 |
| BDL132 | 7473.1 | P | | | 0.47 | | | 0.46 | | | 0.50 | | |
| BDL132 | 7473.1 | Av. | | | 4.65 | | | 4.79 | | | 69.02 | | |
| BDL132 | 7474.4 | P | | 0.93 | 0.50 | 0.68 | | 0.51 | | | 0.49 | | |
| BDL132 | 7474.4 | Av. | | 1.24 | 8.05 | 1.24 | | 5.70 | | | 10.13 | | |
| BDL132 | 7471.1 | P | | | | 0.50 | | | | | 0.23 | | |
| BDL132 | 7471.1 | Av. | | | | 1.28 | | | | | 1.24 | | |
| BDL132 | 7471.4 | P | | | 0.45 | | 0.10 | | | | | | 0.10 |
| BDL132 | 7471.4 | Av. | | | 1.84 | | 1.16 | | | | | | 1.16 |
| BDL132 | 7472.4 | P | | | | 0.49 | | | 0.10 | | | | |
| BDL132 | 7472.4 | Av. | | | | 1.87 | | | 1.09 | | | | |
| BDL132 | 7473.1 | P | 0.63 | | 0.29 | 0.61 | | | 0.28 | | 0.03 | | |
| BDL132 | 7473.1 | Av. | 1.20 | | 1.38 | 1.36 | | | 1.23 | | 1.21 | | |
| BDL132 | 7475.4 | P | | 0.37 | | | | | | 0.70 | 0.51 | | |
| BDL132 | 7475.4 | Av. | | 1.75 | | | | | | 1.11 | 1.16 | | |
| BDL133 | 8161.1 | P | | 0.02 | | 0.56 | | | | 0.74 | | | |
| BDL133 | 8161.1 | Av. | | 2.12 | | 1.17 | | | | 1.43 | | | |
| BDL133 | 8161.2 | P | | | | 0.34 | | | | | | | |
| BDL133 | 8161.2 | Av. | | | | 1.16 | | | | | | | |
| BDL133 | 8161.3 | P | 0.32 | 0.48 | 0.66 | | 0.73 | 0.63 | | 0.60 | | 0.30 | 0.73 |
| BDL133 | 8161.3 | Av. | 1.12 | 15.21 | 1.24 | | 1.31 | 1.13 | | 1.76 | | 1.22 | 1.31 |
| BDL133 | 8161.4 | P | 0.16 | 0.36 | | 0.12 | | | 0.24 | | 0.00 | | |
| BDL133 | 8161.4 | Av. | 1.13 | 1.48 | | 1.24 | | | 1.13 | | 1.43 | | |
| BDL133 | 8162.1 | P | | | | 0.07 | | | | | | | |
| BDL133 | 8162.1 | Av. | | | | 1.39 | | | | | | | |
| BDL133 | 8162.3 | P | | | | | | | | | | 0.19 | |
| BDL133 | 8162.3 | Av. | | | | | | | | | | 1.13 | |
| BDL133 | 8162.5 | P | | | | | | 0.02 | | | | | |
| BDL133 | 8162.5 | Av. | | | | | | 1.20 | | | | | |
| BDL133 | 8163.2 | P | | | 0.51 | | | | | | | | |
| BDL133 | 8163.2 | Av. | | | 1.38 | | | | | | | | |
| BDL134 | 7671.2 | P | | 0.40 | | 0.02 | | | 0.26 | 0.57 | | 0.11 | |
| BDL134 | 7671.2 | Av. | | 3.72 | | 1.79 | | | 1.15 | 3.46 | | 1.22 | |
| BDL134 | 7672.1 | P | | 0.26 | 0.44 | | | 0.08 | | | 0.49 | 0.00 | |
| BDL134 | 7672.1 | Av. | | 4.40 | 1.24 | | | 1.26 | | | 1.14 | 1.29 | |
| BDL134 | 7673.1 | P | | 0.46 | 0.16 | 0.07 | | 0.07 | | | 0.01 | | |
| BDL134 | 7673.1 | Av. | | 13.42 | 1.44 | 1.30 | | 1.14 | | | 1.37 | | |
| BDL134 | 7673.2 | P | | 0.02 | 0.16 | | | 0.15 | | | | 0.32 | |
| BDL134 | 7673.2 | Av. | | 1.63 | 1.28 | | | 1.18 | | | | 1.12 | |
| BDL135 | 7722.1 | P | | | 0.47 | | | 0.29 | | | | | |
| BDL135 | 7722.1 | Av. | | | 1.18 | | | 1.16 | | | | | |
| BDL135 | 7723.1 | P | | | 0.56 | | 0.62 | 0.03 | | 0.57 | 0.54 | | 0.62 |
| BDL135 | 7723.1 | Av. | | | 1.14 | | 2.29 | 1.18 | | 3.83 | 1.22 | | 2.29 |
| BDL135 | 7723.3 | P | | | | | | | | | | | |
| BDL135 | 7723.3 | Av. | | | | | | | | | | | |
| BDL135 | 7723.8 | P | | | | 0.74 | | 0.25 | | | | 0.56 | |
| BDL135 | 7723.8 | Av. | | | | 1.15 | | 1.12 | | | | 1.13 | |
| BDL135 | 7723.9 | P | | | | 0.71 | | | | | | | |
| BDL135 | 7723.9 | Av. | | | | 1.14 | | | | | | | |
| BDL136 | 7751.4 | P | | | 0.05 | | | 0.13 | | | | | |
| BDL136 | 7751.4 | Av. | | | 1.51 | | | 1.12 | | | | | |
| BDL136 | 7751.5 | P | | 0.38 | 0.39 | 0.42 | | 0.24 | | | 0.40 | 0.42 | |
| BDL136 | 7751.5 | Av. | | 1.51 | 1.34 | 1.11 | | 1.11 | | | 1.11 | 1.12 | |
| BDL136 | 7751.8 | P | 0.12 | | | | | | | | | | |
| BDL136 | 7751.8 | Av. | 1.10 | | | | | | | | | | |
| BDL136 | 7752.6 | P | | | 0.40 | | | | | | 0.16 | | |
| BDL136 | 7752.6 | Av. | | | 1.16 | | | | | | 1.16 | | |
| BDL137 | 7701.2 | P | | 0.50 | 0.52 | | 0.75 | 0.13 | | 0.73 | 0.41 | 0.41 | 0.75 |
| BDL137 | 7701.2 | Av. | | 14.76 | 1.24 | | 1.41 | 1.25 | | 1.42 | 1.11 | 1.14 | 1.41 |
| BDL137 | 7701.5 | P | | 0.53 | | 0.64 | | | | | | 0.05 | |
| BDL137 | 7701.5 | Av. | | 1.50 | | 1.25 | | | | | | 1.14 | |
| BDL137 | 7701.6 | P | | | | 0.76 | | 0.55 | | | | | |
| BDL137 | 7701.6 | Av. | | | | 1.13 | | 1.11 | | | | | |
| BDL137 | 7702.1 | P | | 0.05 | 0.37 | 0.03 | | 0.17 | 0.25 | | 0.16 | | |
| BDL137 | 7702.1 | Av. | | 2.52 | 1.20 | 1.51 | | 1.25 | 1.13 | | 1.43 | | |
| BDL137 | 7703.2 | P | 0.18 | | 0.10 | | | | | | | 0.07 | |

TABLE 27-continued

| | | | | | | | | | | | | | |
|---|---|---|---|---|---|---|---|---|---|---|---|---|---|
| BDL137 | 7703.2 | Av. | 1.24 | | 1.43 | | | | | | | 1.19 | |
| BDL137 | 7703.3 | P | | | 0.34 | 0.21 | | 0.67 | 0.22 | | | 0.00 | |
| BDL137 | 7703.3 | Av. | | | 1.27 | 1.35 | | 1.11 | 1.15 | | | 1.29 | |
| BDL137 | 7703.7 | P | | | 0.15 | | | 0.02 | | | | 0.10 | |
| BDL137 | 7703.7 | Av. | | | 1.32 | | | 1.21 | | | | 1.12 | |
| BDL139 | 8131.1 | P | | | | | | | | | | | |
| BDL139 | 8131.1 | Av. | | | | | | | | | | | |
| BDL139 | 8131.2 | P | 0.25 | 0.01 | 0.63 | | | 0.56 | | | 0.05 | 0.26 | |
| BDL139 | 8131.2 | Av. | 1.19 | 1.83 | 1.16 | | | 1.13 | | | 1.23 | 1.16 | |
| BDL139 | 8132.7 | P | | | | | | | | | | | |
| BDL139 | 8132.7 | Av. | | | | | | | | | | | |
| BDL139 | 8133.2 | P | | | | | | | | | | | |
| BDL139 | 8133.2 | Av. | | | | | | | | | | | |
| BDL141 | 8141.2 | P | | | | | | | | | 0.15 | | |
| BDL141 | 8141.2 | Av. | | | | | | | | | 1.16 | | |
| BDL141 | 8142.2 | P | | | | | | | | | | | |
| BDL141 | 8142.2 | Av. | | | | | | | | | | | |
| BDL142 | 8282.1 | P | 0.03 | 0.43 | 0.62 | | | 0.20 | | | 0.03 | 0.10 | |
| BDL142 | 8282.1 | Av. | 1.16 | 1.25 | 1.25 | | | 1.14 | | | 1.20 | 1.12 | |
| BDL142 | 8283.1 | P | 0.41 | 0.33 | 0.52 | | | 0.11 | | 0.59 | | 0.16 | |
| BDL142 | 8283.1 | Av. | 1.23 | 8.56 | 1.27 | | | 1.16 | | 2.47 | | 1.28 | |
| BDL142 | 8283.2 | P | 0.27 | | 0.05 | | | 0.30 | | | 0.48 | | |
| BDL142 | 8283.2 | Av. | 1.14 | | 1.42 | | | 1.18 | | | 1.15 | | |
| BDL142 | 8284.1 | P | | | 0.83 | 0.57 | | 0.41 | | | 0.38 | | |
| BDL142 | 8284.1 | Av. | | | 1.11 | 1.14 | | 1.16 | | | 1.32 | | |
| BDL142 | 8285.3 | P | 0.03 | 0.34 | 0.65 | | | 0.41 | 0.44 | 0.57 | 0.01 | 0.18 | |
| BDL142 | 8285.3 | Av. | 1.17 | 2.67 | 1.20 | | | 1.22 | 1.16 | 2.90 | 1.31 | 1.21 | |
| BDL142 | 8285.5 | P | | | | | | | | | | | |
| BDL142 | 8285.5 | Av. | | | | | | | | | | | |
| BDL143 | 8411.1 | P | 0.40 | | | | | | | | 0.37 | | |
| BDL143 | 8411.1 | Av. | 1.21 | | | | | | | | 1.24 | | |
| BDL143 | 8411.5 | P | | | | | | 0.54 | | | | 0.54 | |
| BDL143 | 8411.5 | Av. | | | | | | 1.13 | | | | 1.10 | |
| BDL143 | 8412.2 | P | | 0.43 | | 0.01 | | 0.03 | | | | 0.14 | |
| BDL143 | 8412.2 | Av. | | 1.32 | | 1.54 | | 1.22 | | | | 1.28 | |
| BDL143 | 8412.4 | P | | | | 0.01 | | | 0.47 | | 0.56 | 0.03 | |
| BDL143 | 8412.4 | Av. | | | | 2.08 | | | 1.18 | | 1.17 | 1.30 | |
| BDL143 | 8413.3 | P | | 0.02 | 0.15 | | | 0.18 | | | | 0.00 | |
| BDL143 | 8413.3 | Av. | | 1.72 | 1.35 | | | 1.11 | | | | 1.24 | |
| BDL143 | 8414.4 | P | | | | 0.36 | | | | | 0.79 | | |
| BDL143 | 8414.4 | Av. | | | | 1.18 | | | | | 1.15 | | |
| BDL143 | 8414.5 | P | | 0.16 | | | | | | | | | |
| BDL143 | 8414.5 | Av. | | 1.17 | | | | | | | | | |
| BDL144 | 8384.1 | P | | 0.58 | | 0.28 | | 0.18 | | | | 0.41 | |
| BDL144 | 8384.1 | Av. | | 1.33 | | 1.47 | | 1.13 | | | | 1.18 | |
| BDL144 | 8384.5 | P | | | | 0.08 | | | 0.14 | | | | |
| BDL144 | 8384.5 | Av. | | | | 1.45 | | | 1.20 | | | | |
| BDL144 | 8385.1 | P | | 0.00 | 0.76 | 0.06 | | 0.40 | 0.05 | | | 0.23 | |
| BDL144 | 8385.1 | Av. | | 3.33 | 1.11 | 1.69 | | 1.24 | 1.20 | | | 1.40 | |
| BDL145 | 8233.2 | P | | 0.15 | 0.05 | | | 0.13 | | | 0.15 | | |
| BDL145 | 8233.2 | Av. | | 1.48 | 1.51 | | | 1.23 | | | 1.14 | | |
| BDL145 | 8233.3 | P | | 0.39 | | 0.02 | | 0.58 | 0.56 | | 0.05 | 0.00 | |
| BDL145 | 8233.3 | Av. | | 14.58 | | 1.62 | | 1.15 | 1.12 | | 1.28 | 1.28 | |
| BDL145 | 8235.1 | P | | 0.30 | | 0.15 | | | | | | 0.21 | |
| BDL145 | 8235.1 | Av. | | 1.19 | | 1.53 | | | | | | 1.20 | |
| BDL145 | 8235.3 | P | | 0.19 | | 0.02 | | | 0.29 | | 0.39 | 0.11 | |
| BDL145 | 8235.3 | Av. | | 5.48 | | 1.65 | | | 1.20 | | 1.31 | 1.27 | |
| BDL145 | 8235.4 | P | | | | | | | | | | | |
| BDL145 | 8235.4 | Av. | | | | | | | | | | | |
| BDL146 | 8241.1 | P | | | 0.17 | | | | | | | | |
| BDL146 | 8241.1 | Av. | | | 1.32 | | | | | | | | |
| BDL146 | 8241.3 | P | 0.31 | 0.60 | | | | | 0.00 | | | 0.00 | |
| BDL146 | 8241.3 | Av. | 1.18 | 1.24 | | | | | 1.17 | | | 1.35 | |
| BDL146 | 8243.2 | P | | | | | | 0.20 | | | | | |
| BDL146 | 8243.2 | Av. | | | | | | 1.14 | | | | | |
| BDL146 | 8243.5 | P | | 0.73 | 0.33 | 0.44 | | 0.03 | | | | 0.00 | |
| BDL146 | 8243.5 | Av. | | 1.22 | 1.43 | 1.42 | | 1.23 | | | | 1.39 | |
| BDL146 | 8244.4 | P | 0.43 | | 0.19 | | 0.58 | 0.08 | | 0.67 | 0.43 | | 0.58 |
| BDL146 | 8244.4 | Av. | 1.15 | | 1.26 | | 2.83 | 1.16 | | 1.68 | 1.21 | | 2.83 |
| BDL146 | 8244.7 | P | | 0.00 | 0.61 | 0.23 | | 0.15 | | | 0.07 | | |
| BDL146 | 8244.7 | Av. | | 1.96 | 1.18 | 1.39 | | 1.14 | | | 1.33 | | |
| BDL146 | 8245.2 | P | | | 0.10 | | | 0.03 | | | 0.02 | | |
| BDL146 | 8245.2 | Av. | | | 1.34 | | | 1.18 | | | 1.50 | | |
| BDL146 | 8245.5 | P | | | | | | | | | | | |
| BDL146 | 8245.5 | Av. | | | | | | | | | | | |
| BDL42 | 7771.1 | P | | | | | | | | | | | |
| BDL42 | 7771.1 | Av. | | | | | | | | | | | |
| BDL42 | 7772.1 | P | | | | | | | | | | | |
| BDL42 | 7772.1 | Av. | | | | | | | | | | | |
| BDL42 | 7772.7 | P | | | | | | | | | | | |

TABLE 27-continued

| | | | | | | | | | | | | | |
|---|---|---|---|---|---|---|---|---|---|---|---|---|---|
| BDL42 | 7772.7 | Av. | | | | | | | | | | | |
| BDL42 | 7774.1 | P | | 0.07 | 0.58 | 0.00 | | | 0.06 | | 0.24 | 0.12 | |
| BDL42 | 7774.1 | Av. | | 5.75 | 1.14 | 1.59 | | | 1.11 | | 1.21 | 1.19 | |
| BDL42 | 7774.2 | P | | | | | | | | | | | |
| BDL42 | 7774.2 | Av. | | | | | | | | | | | |
| BDL42 | 7774.4 | P | | 0.47 | | 0.01 | | | | | | | |
| BDL42 | 7774.4 | Av. | | 4.18 | | 1.81 | | | | | | | |
| BDL46 | 7833.3 | P | | 0.02 | 0.32 | 0.45 | | 0.19 | | | | | |
| BDL46 | 7833.3 | Av. | | 1.37 | 1.44 | 1.68 | | 1.36 | | | | | |
| BDL46 | 7833.4 | P | | | 0.56 | | | | | | | | |
| BDL46 | 7833.4 | Av. | | | 1.19 | | | | | | | | |
| BDL46 | 7833.5 | P | | 0.47 | 0.45 | 0.51 | 0.54 | | | | | | 0.54 |
| BDL46 | 7833.5 | Av. | | 2.25 | 1.14 | 1.32 | 1.31 | | | | | | 1.31 |
| BDL46 | 7833.6 | P | | | 0.14 | 0.30 | | 0.61 | | | | | |
| BDL46 | 7833.6 | Av. | | | 1.21 | 1.24 | | 1.19 | | | | | |
| BDL46 | 7834.1 | P | | | | 0.75 | | | | | | 0.46 | |
| BDL46 | 7834.1 | Av. | | | | 1.13 | | | | | | 1.15 | |
| BDL46 | 7833.1 | P | | 0.20 | 0.43 | 0.09 | | 0.02 | | | 0.21 | 0.39 | |
| BDL46 | 7833.1 | Av. | | 2.16 | 1.47 | 1.70 | | 1.18 | | | 1.32 | 1.20 | |
| BDL46 | 7833.3 | P | | | | 0.81 | | | | | | | |
| BDL46 | 7833.3 | Av. | | | | 1.20 | | | | | | | |
| BDL46 | 7833.4 | P | | | | 0.33 | | | | | | | |
| BDL46 | 7833.4 | Av. | | | | 1.73 | | | | | | | |
| BDL46 | 7833.5 | P | | 0.65 | | 0.17 | | | | | | 0.32 | |
| BDL46 | 7833.5 | Av. | | 1.14 | | 1.77 | | | | | | 1.24 | |
| BDL46 | 7834.4 | P | 0.02 | 0.27 | | 0.02 | | | 0.02 | | 0.29 | 0.00 | |
| BDL46 | 7834.4 | Av. | 1.22 | 1.96 | | 2.26 | | | 1.29 | | 1.13 | 1.33 | |
| BDL51 | 7291.1 | P | | 0.19 | 0.78 | 0.00 | 0.31 | | | 0.81 | 0.49 | 0.04 | 0.31 |
| BDL51 | 7291.1 | Av. | | 3.97 | 1.19 | 1.77 | 1.82 | | | 1.21 | 1.32 | 1.23 | 1.82 |
| BDL51 | 8021.1 | P | | | | 0.02 | 0.93 | 0.50 | 0.13 | | | | 0.93 |
| BDL51 | 8021.1 | Av. | | | | 3.28 | 1.18 | 26.01 | 1.15 | | | | 1.18 |
| BDL51 | 8022.4 | P | | | 0.04 | 0.03 | | 0.34 | | 0.77 | | 0.40 | |
| BDL51 | 8022.4 | Av. | | | 2.98 | 2.43 | | 1.54 | | 1.17 | | 1.15 | |
| BDL51 | 8022.5 | P | 0.35 | 0.44 | 0.44 | 0.13 | | | 0.03 | | | 0.50 | |
| BDL51 | 8022.5 | Av. | 1.19 | 4.24 | 2.39 | 3.03 | | | 1.43 | | | 1.25 | |
| BDL51 | 8024.4 | P | | 0.39 | 0.00 | 0.28 | 0.66 | 0.53 | 0.30 | 0.55 | 0.28 | | 0.66 |
| BDL51 | 8024.4 | Av. | | 3.38 | 1.69 | 1.63 | 1.32 | 1.30 | 1.15 | 1.30 | 1.26 | | 1.32 |
| BDL51 | 8024.7 | P | | | 0.33 | 0.37 | | 0.41 | | | | | |
| BDL51 | 8024.7 | Av. | | | 1.29 | 1.39 | | 1.21 | | | | | |
| BDL52 | 7861.1 | P | | 0.72 | | 0.57 | 0.61 | | | | | | 0.61 |
| BDL52 | 7861.1 | Av. | | 1.25 | | 1.24 | 1.18 | | | | | | 1.18 |
| BDL52 | 7861.5 | P | | | 0.11 | 0.68 | | 0.01 | | | | | |
| BDL52 | 7861.5 | Av. | | | 1.31 | 1.14 | | 1.27 | | | | | |
| BDL52 | 7863.2 | P | | | | 0.82 | | | | | | | |
| BDL52 | 7863.2 | Av. | | | | 1.21 | | | | | | | |
| BDL52 | 7864.5 | P | | | | 0.61 | 0.76 | 0.71 | | | 0.40 | | 0.76 |
| BDL52 | 7864.5 | Av. | | | | 1.25 | 1.17 | 1.10 | | | 1.26 | | 1.17 |
| BDL54 | 7781.1 | P | | | 0.50 | 0.73 | | 0.50 | | | 0.47 | | |
| BDL54 | 7781.1 | Av. | | | 13.03 | 1.16 | | 6.59 | | | 3.90 | | |
| BDL54 | 7781.4 | P | | 0.06 | 0.09 | 0.78 | | 0.27 | | | 0.55 | | |
| BDL54 | 7781.4 | Av. | | 1.28 | 1.25 | 1.13 | | 1.19 | | | 1.22 | | |
| BDL54 | 7784.3 | P | | 0.87 | 0.49 | 0.16 | | 0.48 | 0.05 | | 0.49 | 0.06 | |
| BDL54 | 7784.3 | Av. | | 1.49 | 9.56 | 1.68 | | 5.77 | 1.15 | | 14.83 | 1.26 | |
| BDL54 | 7784.5 | P | | 0.44 | | | | 0.47 | | | 0.07 | | |
| BDL54 | 7784.5 | Av. | | 1.49 | | | | 1.19 | | | 1.27 | | |
| BDL54 | 7785.4 | P | | 0.16 | 0.06 | | | 0.36 | | | | 0.00 | |
| BDL54 | 7785.4 | Av. | | 1.52 | 1.40 | | | 1.22 | | | | 1.30 | |
| BDL54 | 7781.1 | P | | 0.55 | 0.19 | 0.08 | | | 0.23 | | | 0.10 | |
| BDL54 | 7781.1 | Av. | | 1.50 | 1.33 | 3.05 | | | 1.13 | | | 1.27 | |
| BDL54 | 7781.4 | P | | 0.04 | 0.25 | 0.01 | | | 0.52 | | 0.00 | | |
| BDL54 | 7781.4 | Av. | | 1.87 | 1.36 | 1.85 | | | 1.18 | | 1.37 | | |
| BDL54 | 7784.3 | P | | 0.49 | 0.47 | 0.43 | | | 0.02 | | | 0.03 | |
| BDL54 | 7784.3 | Av. | | 1.54 | 1.37 | 1.81 | | | 1.14 | | | 1.30 | |
| BDL54 | 7785.4 | P | | | | 0.40 | | | | | | 0.67 | |
| BDL54 | 7785.4 | Av. | | | | 1.57 | | | | | | 1.13 | |
| BDL54 | 7785.8 | P | | | 0.41 | | | | | | 0.07 | 0.10 | |
| BDL54 | 7785.8 | Av. | | | 1.39 | | | | | | 1.21 | 1.28 | |
| BDL56 | 7181.2 | P | | | 0.51 | 0.51 | | 0.50 | | | 0.43 | | |
| BDL56 | 7181.2 | Av. | | | 3.81 | 1.79 | | 3.28 | | | 3.75 | | |
| BDL56 | 8301.1 | P | | | | | | | | | | | |
| BDL56 | 8301.1 | Av. | | | | | | | | | | | |
| BDL56 | 8301.3 | P | | | 0.42 | | | 0.64 | | | | 0.34 | |
| BDL56 | 8301.3 | Av. | | | 1.10 | | | 1.15 | | | | 1.11 | |
| BDL56 | 8304.1 | P | | | | 0.40 | | | | | | | |
| BDL56 | 8304.1 | Av. | | | | 1.12 | | | | | | | |
| BDL56 | 8305.1 | P | | 0.19 | 0.52 | | 0.76 | 0.71 | | | | | 0.76 |
| BDL56 | 8305.1 | Av. | | 1.17 | 1.26 | | 1.11 | 1.13 | | | | | 1.11 |
| BDL56 | 8301.1 | P | 0.64 | 0.70 | 0.70 | 0.65 | | | 0.41 | | | 0.40 | |
| BDL56 | 8301.1 | Av. | 1.21 | 1.29 | 1.11 | 1.33 | | | 1.15 | | | 1.19 | |
| BDL56 | 8301.2 | P | | 0.44 | | 0.13 | | | 0.01 | | 0.01 | 0.12 | |

TABLE 27-continued

| | | | | | | | | | | | | | |
|---|---|---|---|---|---|---|---|---|---|---|---|---|---|
| BDL56 | 8301.2 | Av. | | 2.00 | | 1.67 | | | 1.17 | | 1.30 | 1.32 | |
| BDL56 | 8301.3 | P | | 0.23 | 0.23 | 0.63 | 0.61 | | | | 0.38 | | 0.61 |
| BDL56 | 8301.3 | Av. | | 1.11 | 1.70 | 1.46 | 1.18 | | | | 1.36 | | 1.18 |
| BDL56 | 8303.1 | P | | | | 0.53 | | | | | | | |
| BDL56 | 8303.1 | Av. | | | | 1.39 | | | | | | | |
| BDL56 | 8303.2 | P | | | 0.29 | 0.39 | 0.16 | | | | | | 0.16 |
| BDL56 | 8303.2 | Av. | | | 1.32 | 1.78 | 1.12 | | | | | | 1.12 |
| BDL56 | 7792.1 | P | | | | | | | | | | | |
| BDL59 | 7792.1 | Av. | | | | | | | | | | | |
| BDL59 | 7792.2 | P | | | | 0.70 | | | | | 0.20 | | |
| BDL59 | 7792.2 | Av. | | | | 1.19 | | | | | 1.16 | | |
| BDL59 | 7792.3 | P | | | | 0.31 | | | | | | | |
| BDL59 | 7792.3 | Av. | | | | 1.43 | | | | | | | |
| BDL59 | 7793.3 | P | | 0.66 | 0.04 | | 0.57 | 0.56 | | | | | 0.57 |
| BDL59 | 7793.3 | Av. | | 1.48 | 1.43 | | 1.40 | 1.11 | | | | | 1.40 |
| BDL59 | 7794.1 | P | | | 0.13 | | | 0.01 | | | 0.36 | | |
| BDL59 | 7794.1 | Av. | | | 7.90 | | | 6.46 | | | 4.80 | | |
| BDL60 | 8011.4 | P | | | | | | | | | | | |
| BDL60 | 8011.4 | Av. | | | | | | | | | | | |
| BDL60 | 8011.7 | P | | | 0.49 | 0.00 | | 0.48 | | | 0.47 | 0.06 | |
| BDL60 | 8011.7 | Av. | | | 10.85 | 1.51 | | 5.59 | | | 2.44 | 1.28 | |
| BDL60 | 8013.4 | P | | 0.97 | | 0.39 | | 0.50 | 0.38 | | 0.49 | 0.35 | |
| BDL60 | 8013.4 | Av. | | 1.10 | | 1.66 | | 27.18 | 1.13 | | 16.70 | 1.20 | |
| BDL60 | 8013.6 | P | | 0.35 | | 0.74 | | 0.62 | 0.14 | | 0.25 | | |
| BDL60 | 8013.6 | Av. | | 2.43 | | 1.34 | | 1.18 | 1.10 | | 1.12 | | |
| BDL60 | 8014.5 | P | | 0.48 | | 0.10 | 0.61 | | | 0.72 | 0.37 | | 0.61 |
| BDL60 | 8014.5 | Av. | | 3.21 | | 1.73 | 1.43 | | | 1.20 | 1.12 | | 1.43 |
| BDL60 | 8013.6 | P | | 0.78 | | 0.59 | | | 0.02 | | 0.24 | 0.35 | |
| BDL60 | 8013.6 | Av. | | 1.15 | | 1.37 | | | 1.12 | | 1.22 | 1.15 | |
| BDL60 | 8014.2 | P | | 0.02 | | 0.01 | | | | | 0.02 | 0.01 | |
| BDL60 | 8014.2 | Av. | | 2.03 | | 2.05 | | | | | 1.35 | 1.19 | |
| BDL60 | 8014.7 | P | | 0.40 | 0.17 | 0.72 | | 0.07 | | | 0.01 | 0.04 | |
| BDL60 | 8014.7 | Av. | | 1.23 | 1.32 | 1.20 | | 1.22 | | | 1.33 | 1.17 | |
| BDL60 | 8014.8 | P | | | 0.72 | 0.01 | 0.46 | | 0.14 | 0.61 | 0.29 | | 0.46 |
| BDL60 | 8014.8 | Av. | | | 1.53 | 1.95 | 1.30 | | 1.10 | 1.19 | 1.18 | | 1.30 |
| BDL65 | 7824.1 | P | | 0.73 | | 0.69 | | | | | | 0.27 | |
| BDL65 | 7824.1 | Av. | | 1.40 | | 1.11 | | | | | | 1.13 | |
| BDL65 | 7825.2 | P | | | 0.20 | 0.56 | | | | | | 0.03 | |
| BDL65 | 7825.2 | Av. | | | 1.25 | 1.33 | | | | | | 1.33 | |
| BDL65 | 8473.2 | P | | 0.10 | 0.37 | 0.00 | | 0.01 | 0.01 | 0.45 | 0.50 | 0.05 | |
| BDL65 | 8473.2 | Av. | | 4.55 | 1.17 | 1.69 | | 1.27 | 1.22 | 3.42 | 1.42 | 1.33 | |
| BDL65 | 8474.1 | P | | | | 0.58 | | | | | | | |
| BDL65 | 8474.1 | Av. | | | | 1.11 | | | | | | | |
| BDL65 | 7901.5 | P | | 0.42 | 0.46 | 0.00 | 0.52 | | | | | 0.38 | 0.52 |
| BDL67 | 7901.5 | Av. | | 1.92 | 1.10 | 1.70 | 1.27 | | | | | 1.13 | 1.27 |
| BDL67 | 7902.3 | P | 0.30 | | 0.48 | | | 0.48 | | | 0.50 | 0.50 | |
| BDL67 | 7902.3 | Av. | 1.22 | | 8.10 | | | 5.44 | | | 20.18 | 1.19 | |
| BDL67 | 7902.7 | P | | | 0.49 | 0.12 | | 0.50 | 0.08 | | 0.50 | | |
| BDL67 | 7902.7 | Av. | | | 8.01 | 1.43 | | 6.31 | 1.13 | | 6.95 | | |
| BDL67 | 7903.3 | P | | 0.52 | 0.33 | | | | | | | | |
| BDL67 | 7903.3 | Av. | | 1.23 | 1.21 | | | | | | | | |
| BDL67 | 7903.5 | P | 0.26 | 0.00 | | 0.35 | 0.47 | | 0.00 | | | 0.15 | 0.47 |
| BDL67 | 7903.5 | Av. | 1.10 | 3.19 | | 1.61 | 1.29 | | 1.26 | | | 1.39 | 1.29 |
| BDL68 | 7761.3 | P | | | | 0.26 | | 0.49 | | | 0.50 | | |
| BDL68 | 7761.3 | Av. | | | | 1.25 | | 12.65 | | | 24.18 | | |
| BDL68 | 7761.8 | P | | 0.48 | 0.50 | 0.01 | | 0.19 | 0.08 | | 0.36 | 0.08 | |
| BDL68 | 7761.8 | Av. | | 10.41 | 1.23 | 1.49 | | 1.67 | 1.18 | | 1.42 | 1.41 | |
| BDL68 | 7761.9 | P | | | | 0.25 | 0.49 | 0.44 | | 0.59 | 0.13 | 0.00 | 0.49 |
| BDL68 | 7761.9 | Av. | | | | 1.73 | 2.09 | 1.22 | | 1.23 | 1.69 | 1.45 | 2.09 |
| BDL68 | 7763.2 | P | | 0.40 | | 0.03 | 0.51 | | 0.02 | 0.75 | 0.05 | 0.20 | 0.51 |
| BDL68 | 7763.2 | Av. | | 3.14 | | 1.55 | 1.54 | | 1.18 | 1.20 | 1.46 | 1.21 | 1.54 |
| BDL68 | 7764.1 | P | | 0.55 | 0.50 | 0.33 | | 0.49 | 0.03 | | 0.47 | 0.01 | |
| BDL68 | 7764.1 | Av. | | 10.21 | 13.08 | 1.50 | | 7.93 | 1.16 | | 5.30 | 1.27 | |
| BDL78 | 7911.11 | P | 0.13 | | 0.52 | | | | | | | 0.35 | |
| BDL78 | 7911.11 | Av. | 1.12 | | 1.17 | | | | | | | 1.23 | |
| BDL78 | 7911.8 | P | 0.51 | | 0.64 | | | | 0.07 | | | 0.22 | |
| BDL78 | 7911.8 | Av. | 1.15 | | 1.26 | | | | 1.07 | | | 1.11 | |
| BDL78 | 7911.9 | P | | 0.22 | | 0.00 | | 0.06 | | | 0.38 | 0.39 | |
| BDL78 | 7911.9 | Av. | | 7.52 | | 1.82 | | 1.19 | | | 1.17 | 1.16 | |
| BDL78 | 7912.6 | P | | | 0.58 | 0.14 | | 0.20 | | | 0.24 | | |
| BDL78 | 7912.6 | Av. | | | 1.10 | 1.31 | | 1.19 | | | 1.22 | | |
| BDL78 | 7913.11 | P | 0.20 | 0.21 | | | | 0.14 | 0.29 | | 0.53 | 0.36 | |
| BDL78 | 7913.11 | Av. | 1.18 | 1.99 | | | | 1.13 | 1.11 | | 1.23 | 1.43 | |
| BDL78 | 7913.3 | P | | | | | | | | | | | |
| BDL78 | 7913.3 | Av. | | | | | | | | | | | |
| BDL78 | 7913.6 | P | | 0.42 | | 0.04 | | 0.09 | | | 0.61 | 0.01 | |
| BDL78 | 7913.6 | Av. | | 11.13 | | 1.45 | | 1.21 | | | 1.23 | 1.22 | |
| BDL78 | 7913.8 | P | | | 0.11 | | | 0.07 | | | | 0.04 | |
| BDL78 | 7913.8 | Av. | | | 1.33 | | | 1.16 | | | | 1.15 | |
| BDL78 | 7913.9 | P | | 0.48 | | 0.63 | | | 0.24 | 0.54 | | 0.01 | |

TABLE 27-continued

| Gene | Ev. | Par. | 46 | 47 | 48 | 49 | 50 | 51 | 52 | 53 | 54 | 55 |
|---|---|---|---|---|---|---|---|---|---|---|---|---|
| BDL78 | 7913.9 | Av. | 1.85 | | 1.26 | | | 1.16 | 5.72 | | 1.22 | |
| BDL82 | 7801.1 | P | 0.31 | | 0.01 | 0.23 | | 0.05 | 0.37 | | 0.27 | 0.23 |
| BDL82 | 7801.1 | Av. | 3.94 | | 1.88 | 1.44 | | 1.14 | 1.45 | | 1.41 | 1.44 |
| BDL82 | 7801.3 | P | 0.39 | | | 0.47 | | | 0.51 | | | 0.47 |
| BDL82 | 7801.3 | Av. | 13.27 | | | 1.36 | | | 1.21 | | | 1.36 |
| BDL82 | 7802.2 | P | 0.41 | | 0.46 | 0.52 | | | | 0.07 | 0.45 | 0.52 |
| BDL82 | 7802.2 | Av. | 3.78 | | 1.20 | 1.54 | | | | 1.34 | 1.17 | 1.54 |
| BDL82 | 7802.3 | P | 0.18 | 0.02 | 0.45 | | 0.32 | | | 0.12 | 0.06 | |
| BDL82 | 7802.3 | Av. | 2.14 | 1.41 | 1.40 | | 1.14 | | | 1.16 | 1.24 | |
| BDL82 | 7803.9 | P | | | | | 0.54 | | | | | |
| BDL82 | 7803.9 | Av. | | | | | 1.18 | | | | | |
| BDL89 | 7812.2 | P | 0.67 | | 0.26 | | | | | | 0.42 | |
| BDL89 | 7812.2 | Av. | 1.12 | | 1.17 | | | | | | 1.13 | |
| BDL89 | 7812.5 | P | | 0.51 | | | 0.51 | 0.18 | | 0.50 | | |
| BDL89 | 7812.5 | Av. | | 12.24 | | | 5.84 | 1.18 | | 16.66 | | |
| BDL89 | 7814.1 | P | | 0.23 | 0.39 | | 0.58 | | | | 0.06 | |
| BDL89 | 7814.1 | Av. | | 1.16 | 1.14 | | 1.16 | | | | 1.16 | |
| BDL89 | 7814.4 | P | | 0.47 | 0.42 | | 0.46 | 0.05 | | 0.48 | 0.43 | |
| BDL89 | 7814.4 | Av. | | 9.40 | 2.02 | | 5.59 | 1.17 | | 6.76 | 1.21 | |
| BDL89 | 7814.5 | P | 0.47 | | 0.26 | 0.46 | | | 0.52 | 0.20 | 0.15 | 0.46 |
| BDL89 | 7814.5 | Av. | 7.62 | | 1.57 | 1.98 | | | 1.65 | 1.26 | 1.14 | 1.98 |
| BDL95 | 7841.5 | P | | 0.55 | 0.03 | 0.01 | | | | | | |
| BDL95 | 7841.5 | Av. | | 1.11 | 1.14 | 1.09 | | | | | | |
| BDL95 | 7842.12 | P | | | 0.12 | 0.12 | | 0.32 | | | 0.05 | |
| BDL95 | 7842.12 | Av. | | | 1.24 | 1.11 | | 1.28 | | | 1.04 | |
| BDL95 | 7842.2 | P | | | 0.07 | 0.12 | | 0.19 | | 0.20 | 0.00 | |
| BDL95 | 7842.2 | Av. | | | 1.07 | 1.11 | | 1.33 | | 1.14 | 1.12 | |
| BDL95 | 7842.8 | P | | 0.01 | 0.20 | 0.01 | | | | | | |
| BDL95 | 7842.8 | Av. | | 1.21 | 1.31 | 1.09 | | | | | | |
| BDL95 | 7843.4 | P | 0.49 | | 0.01 | | | | | | | |
| BDL95 | 7843.4 | Av. | 5.89 | | 1.24 | | | | | | | |
| BDL100 | 7871.2 | P | 0.37 | | 0.09 | 0.34 | | 0.39 | | | | |
| BDL100 | 7871.2 | Av. | 1.14 | | 1.12 | 1.10 | | 1.16 | | | | |
| BDL100 | 7872.2 | P | 0.26 | | 0.27 | 0.12 | | 0.00 | | | | |
| BDL100 | 7872.2 | Av. | 1.20 | | 1.17 | 1.11 | | 1.49 | | | | |
| BDL100 | 7872.3 | P | | | 0.56 | | | 0.32 | | | | |
| BDL100 | 7872.3 | Av. | | | 1.11 | | | 1.27 | | | | |
| BDL100 | 7873.3 | P | 0.42 | 0.03 | 0.32 | 0.12 | | | | | | |
| BDL100 | 7873.3 | Av. | 1.18 | 1.16 | 1.20 | 1.11 | | | | | | |
| BDL100 | 7873.4 | P | 0.43 | | | | | 0.06 | | | | |
| BDL100 | 7873.4 | Av. | 2.58 | | | | | 1.41 | | | | |
| BDL106 | 7881.1 | P | | | 0.03 | | | | | | | |
| BDL106 | 7881.1 | Av. | | | 1.14 | | | | | | | |
| BDL106 | 7881.4 | P | | | 0.23 | 0.16 | | | | | | |
| BDL106 | 7881.4 | Av. | | | 1.42 | 1.23 | | | | | | |
| BDL106 | 7882.6 | P | 0.04 | | | | | | | | 0.30 | |
| BDL106 | 7882.6 | Av. | 1.15 | | | | | | | | 1.10 | |
| BDL106 | 7884.1 | P | 0.50 | | 0.47 | 0.12 | | | | | | |
| BDL106 | 7884.1 | Av. | 5.79 | | 1.22 | 1.11 | | | | | | |
| BDL106 | 7884.9 | P | | 0.47 | 0.03 | 0.00 | | | | | 0.00 | |
| BDL106 | 7884.9 | Av. | | 1.13 | 1.26 | 1.09 | | | | | 1.09 | |
| BDL106 | 7881.1 | P | | 0.23 | | | | | | | | |
| BDL106 | 7881.1 | Av. | | 1.16 | | | | | | | | |
| BDL106 | 7881.2 | P | | | | | 0.38 | | | | | 0.37 |
| BDL106 | 7881.2 | Av. | | | | | 1.14 | | | | | 1.16 |
| BDL106 | 7882.2 | P | | | | | | | | | | |
| BDL106 | 7882.2 | Av. | | | | | | | | | | |
| BDL106 | 7882.4 | P | | 0.24 | | | | | | | | |
| BDL106 | 7882.4 | Av. | | 1.12 | | | | | | | | |
| BDL106 | 7882.5 | P | | 0.43 | | | 0.35 | | | | | 0.50 |
| BDL106 | 7882.5 | Av. | | 1.21 | | | 1.14 | | | | | 1.13 |
| BDL108 | 8122.2 | P | 0.49 | 0.39 | 0.06 | 0.26 | | | | | 0.08 | |
| BDL108 | 8122.2 | Av. | 4.63 | 1.16 | 1.27 | 1.15 | | | | | 1.09 | |
| BDL108 | 8122.3 | P | | 0.31 | 0.05 | | | | | 0.25 | 0.00 | |
| BDL108 | 8122.3 | Av. | | 1.13 | 1.20 | | | | | 1.17 | 1.11 | |
| BDL108 | 8123.1 | P | | | 0.15 | | | | | | | |
| BDL108 | 8123.1 | Av. | | | 1.13 | | | | | | | |
| BDL108 | 8123.2 | P | 0.52 | 0.50 | 0.00 | 0.05 | | | | 0.53 | | |
| BDL108 | 8123.2 | Av. | 6.48 | 1.30 | 1.35 | 1.15 | | | | 1.21 | | |
| BDL108 | 8123.5 | P | | 0.13 | 0.09 | 0.05 | | | | | | |
| BDL108 | 8123.5 | Av. | | 1.11 | 1.30 | 1.15 | | | | | | |
| BDL108 | 8121.1 | P | | | | | | | | | | |
| BDL108 | 8121.1 | Av. | | | | | | | | | | |
| BDL108 | 8121.3 | P | | | | | | | | | | |
| BDL108 | 8121.3 | Av. | | | | | | | | | | |
| BDL108 | 8121.4 | P | | | | | | | | | | |
| BDL108 | 8121.4 | Av. | | | | | | | | | | |

TABLE 27-continued

| | | | | | | | | | | | | |
|---|---|---|---|---|---|---|---|---|---|---|---|---|
| BDL108 | 8122.7 | P | | | | | | | | | | |
| BDL108 | 8122.7 | Av. | | | | | | | | | | |
| BDL108 | 8123.7 | P | | | | | | | | | | |
| BDL108 | 8123.7 | Av. | | | | | | | | | | |
| BDL110 | 8092.1 | P | | | 0.18 | 0.02 | | | | | | |
| BDL110 | 8092.1 | Av. | | | 1.12 | 1.15 | | | | | | |
| BDL110 | 8092.2 | P | | 0.01 | 0.00 | 0.03 | | | | | | |
| BDL110 | 8092.2 | Av. | | 1.20 | 1.30 | 1.21 | | | | | | |
| BDL110 | 8092.5 | P | | 0.04 | 0.05 | 0.00 | | | | | | |
| BDL110 | 8092.5 | Av. | | 1.09 | 1.14 | 1.12 | | | | | | |
| BDL110 | 8095.2 | P | | | 0.20 | 0.01 | | | | | | |
| BDL110 | 8095.2 | Av. | | | 1.16 | 1.10 | | | | | | |
| BDL111 | 8102.7 | P | 0.04 | | 0.15 | 0.00 | | 0.37 | | | | |
| BDL111 | 8102.7 | Av. | 1.24 | | 1.26 | 1.15 | | 1.28 | | | | |
| BDL111 | 8103.1 | P | 0.20 | | 0.00 | 0.00 | | | | | | |
| BDL111 | 8103.1 | Av. | 1.54 | | 1.20 | 1.16 | | | | | | |
| BDL111 | 8103.2 | P | | | 0.03 | 0.30 | | 0.00 | | | | |
| BDL111 | 8103.2 | Av. | | | 1.34 | 1.14 | | 1.37 | | | | |
| BDL111 | 8103.4 | P | | | 0.00 | 0.12 | | 0.12 | | | 0.00 | |
| BDL111 | 8103.4 | Av. | | | 1.19 | 1.11 | | 1.15 | | | 1.08 | |
| BDL111 | 8103.5 | P | 0.64 | 0.27 | 0.00 | 0.01 | | | | | | |
| BDL111 | 8103.5 | Av. | 1.12 | 1.13 | 1.16 | 1.09 | | | | | | |
| BDL111 | 8102.7 | P | | 0.44 | | | | | | | | |
| BDL111 | 8102.7 | Av. | | 1.12 | | | | | | | | |
| BDL111 | 8103.1 | P | | 0.24 | | | | | | | | 0.18 |
| BDL111 | 8103.1 | Av. | | 1.12 | | | | | | | | 1.17 |
| BDL111 | 8103.2 | P | | | | | | | | | | |
| BDL111 | 8103.2 | Av. | | | | | | | | | | |
| BDL111 | 8103.4 | P | | | | | | | | | | |
| BDL111 | 8103.4 | Av. | | | | | | | | | | |
| BDL111 | 8103.5 | P | | 0.10 | | | | | | | | |
| BDL111 | 8103.5 | Av. | | 1.11 | | | | | | | | |
| BDL112 | 7502.1 | P | 0.07 | | 0.31 | | | 0.07 | | | | |
| BDL112 | 7502.1 | Av. | 1.30 | | 1.13 | | | 1.22 | | | | |
| BDL112 | 7502.14 | P | 0.49 | | 0.56 | | | 0.12 | | | | |
| BDL112 | 7502.14 | Av. | 4.98 | | 1.11 | | | 1.16 | | | | |
| BDL112 | 7502.4 | P | 0.48 | | 0.00 | 0.00 | | | | | 0.03 | |
| BDL112 | 7502.4 | Av. | 1.31 | | 1.16 | 1.09 | | | | | 1.07 | |
| BDL112 | 7502.7 | P | 0.45 | | 0.03 | | | | | | | |
| BDL112 | 7502.7 | Av. | 1.21 | | 1.08 | | | | | | | |
| BDL112 | 7502.9 | P | 0.48 | | 0.00 | 0.08 | | | | | | |
| BDL112 | 7502.9 | Av. | 1.29 | | 1.21 | 1.10 | | | | | | |
| BDL112 | 7502.1 | P | | 0.03 | | | | | | | | |
| BDL112 | 7502.1 | Av. | | 1.11 | | | | | | | | |
| BDL112 | 7502.4 | P | | 0.02 | | | | | | | | 0.08 |
| BDL112 | 7502.4 | Av. | | 1.13 | | | | | | | | 1.10 |
| BDL112 | 7502.7 | P | | 0.00 | | | 0.34 | | | | | 0.05 |
| BDL112 | 7502.7 | Av. | | 1.23 | | | 1.12 | | | | | 1.23 |
| BDL112 | 7502.8 | P | | 0.01 | | | | | | | | |
| BDL112 | 7502.8 | Av. | | 1.15 | | | | | | | | |
| BDL112 | 7502.9 | P | | 0.11 | | | 0.28 | | | | | 0.09 |
| BDL112 | 7502.9 | Av. | | 1.12 | | | 1.25 | | | | | 1.41 |
| BDL113 | 7683.4 | P | | 0.01 | 0.39 | 0.23 | | | | | | |
| BDL113 | 7683.4 | Av. | | 1.23 | 1.28 | 1.14 | | | | | | |
| BDL113 | 7683.6 | P | 0.03 | | 0.39 | 0.26 | | | | | | |
| BDL113 | 7683.6 | Av. | 1.47 | | 1.29 | 1.12 | | | | | | |
| BDL113 | 7684.3 | P | | | 0.34 | 0.17 | | | | | | |
| BDL113 | 7684.3 | Av. | | | 1.30 | 1.14 | | | | | | |
| BDL113 | 7684.6 | P | | 0.51 | 0.00 | 0.01 | | | | | | |
| BDL113 | 7684.6 | Av. | | 1.12 | 1.17 | 1.09 | | | | | | |
| BDL113 | 7684.7 | P | | | 0.22 | 0.00 | | | | | | |
| BDL113 | 7684.7 | Av. | | | 1.19 | 1.15 | | | | | | |
| BDL113 | 7683.1 | P | 0.54 | | | | | | | | | |
| BDL113 | 7683.1 | Av. | 1.15 | | | | | | | | | |
| BDL113 | 7683.11 | P | | | | | | | | | | |
| BDL113 | 7683.11 | Av. | | | | | | | | | | |
| BDL113 | 7683.4 | P | 0.69 | | | | | | | | | |
| BDL113 | 7683.4 | Av. | 1.12 | | | | | | | | | |
| BDL113 | 7684.1 | P | | | | | | | | | | |
| BDL113 | 7684.1 | Av. | | | | | | | | | | |
| BDL113 | 7684.5 | P | | | | | | | | | | |
| BDL113 | 7684.5 | Av. | | | | | | | | | | |
| BDL114 | 7741.3 | P | 0.50 | 0.10 | 0.26 | 0.10 | | | | | | |
| BDL114 | 7741.3 | Av. | 10.33 | 1.14 | 1.27 | 1.15 | | | | | | |
| BDL114 | 7741.6 | P | 0.49 | | 0.40 | | | | | 0.72 | | |
| BDL114 | 7741.6 | Av. | 11.28 | | 1.23 | | | | | 1.12 | | |
| BDL114 | 7742.1 | P | 0.39 | | 0.16 | | | | | | | |
| BDL114 | 7742.1 | Av. | 1.22 | | 1.13 | | | | | | | |
| BDL114 | 7742.3 | P | 0.03 | | 0.20 | 0.15 | | | | | | |
| BDL114 | 7742.3 | Av. | 1.69 | | 1.41 | 1.16 | | | | | | |

TABLE 27-continued

| | | | | | | | | | | | | |
|---|---|---|---|---|---|---|---|---|---|---|---|---|
| BDL114 | 7742.5 | P | 0.45 | 0.17 | 0.06 | 0.07 | | | | | | |
| BDL114 | 7742.5 | Av. | 1.58 | 1.14 | 1.44 | 1.21 | | | | | | |
| BDL115 | 8152.3 | P | | | 0.11 | 0.24 | | 0.03 | | 0.08 | | |
| BDL115 | 8152.3 | Av. | | | 1.26 | 1.14 | | 1.25 | | 1.13 | | |
| BDL115 | 8152.4 | P | | 0.07 | 0.15 | | | | | | | |
| BDL115 | 8152.4 | Av. | | 1.12 | 1.13 | | | | | | | |
| BDL115 | 8154.1 | P | 0.40 | | 0.05 | 0.00 | | 0.31 | | | | |
| BDL115 | 8154.1 | Av. | 1.32 | | 1.31 | 1.14 | | 1.36 | | | | |
| BDL115 | 8155.2 | P | 0.50 | | 0.00 | 0.12 | | | | 0.50 | | |
| BDL115 | 8155.2 | Av. | 6.80 | | 1.24 | 1.11 | | | | 1.13 | | |
| BDL115 | 8155.4 | P | 0.51 | | 0.12 | 0.12 | | | | | | |
| BDL115 | 8155.4 | Av. | 3.59 | | 1.27 | 1.11 | | | | | | |
| BDL115 | 8152.3 | P | | 0.01 | | | | | | | | |
| BDL115 | 8152.3 | Av. | | 1.27 | | | | | | | | |
| BDL115 | 8152.4 | P | 0.25 | 0.08 | | | | | | | | |
| BDL115 | 8152.4 | Av. | 1.20 | 1.19 | | | | | | | | |
| BDL115 | 8154.1 | P | | 0.01 | | | | | | | | 0.17 |
| BDL115 | 8154.1 | Av. | | 1.16 | | | | | | | | 1.43 |
| BDL115 | 8155.2 | P | | | | | | | | | | |
| BDL115 | 8155.2 | Av. | | | | | | | | | | |
| BDL115 | 8155.4 | P | | | | | | | | | | |
| BDL115 | 8155.4 | Av. | | | | | | | | | | |
| BDL116 | 7481.2 | P | 0.12 | | 0.02 | 0.00 | | | | | | |
| BDL116 | 7481.2 | Av. | 1.21 | | 1.32 | 1.17 | | | | | | |
| BDL116 | 7481.7 | P | | 0.44 | 0.00 | 0.00 | | 0.27 | | | | |
| BDL116 | 7481.7 | Av. | | 1.13 | 1.24 | 1.13 | | 1.10 | | | | |
| BDL116 | 7481.8 | P | 0.50 | | 0.56 | 0.36 | | 0.04 | | 0.60 | | |
| BDL116 | 7481.8 | Av. | 5.33 | | 1.12 | 1.11 | | 1.22 | | 1.33 | | |
| BDL116 | 7482.2 | P | | 0.02 | 0.00 | 0.00 | | | | | | |
| BDL116 | 7482.2 | Av. | | 1.18 | 1.20 | 1.04 | | | | | | |
| BDL116 | 7485.1 | P | 0.46 | 0.08 | 0.12 | | | 0.24 | | | | |
| BDL116 | 7485.1 | Av. | 1.27 | 1.20 | 1.27 | | | 1.24 | | | | |
| BDL119 | 7732.2 | P | | 0.09 | 0.02 | 0.00 | 0.12 | | | | | |
| BDL119 | 7732.2 | Av. | | 1.16 | 1.10 | 1.11 | 1.13 | | | | | |
| BDL119 | 7733.2 | P | 0.06 | | | | | | | | | |
| BDL119 | 7733.2 | Av. | 1.21 | | | | | | | | | |
| BDL119 | 7734.1 | P | 0.52 | 0.21 | 0.02 | 0.01 | | | | | | |
| BDL119 | 7734.1 | Av. | 1.12 | 1.13 | 1.11 | 1.10 | | | | | | |
| BDL119 | 7734.5 | P | | | | | | | 0.14 | | | |
| BDL119 | 7734.5 | Av. | | | | | | | 1.13 | | | |
| BDL119 | 7734.7 | P | | | | | | | | | | |
| BDL119 | 7734.7 | Av. | | | | | | | | | | |
| BDL120 | 7891.3 | P | | 0.02 | 0.00 | 0.12 | | 0.51 | | | | |
| BDL120 | 7891.3 | Av. | | 1.19 | 1.34 | 1.11 | | 1.22 | | | | |
| BDL120 | 7892.4 | P | 0.03 | | 0.23 | | | 0.37 | | | | |
| BDL120 | 7892.4 | Av. | 1.28 | | 1.15 | | | 1.11 | | | | |
| BDL120 | 7892.6 | P | | | 0.15 | | | | | 0.00 | 0.07 | |
| BDL120 | 7892.6 | Av. | | | 1.13 | | | | | 1.34 | 1.11 | |
| BDL120 | 7893.2 | P | 0.19 | 0.14 | 0.07 | 0.21 | | 0.06 | | | | |
| BDL120 | 7893.2 | Av. | 11.26 | 1.13 | 1.29 | 1.11 | | 1.20 | | | | |
| BDL120 | 7893.5 | P | | | 0.03 | | | 0.25 | | | | |
| BDL120 | 7893.5 | Av. | | | 1.08 | | | 1.17 | | | | |
| BDL122 | 7513.1 | P | | | | | | 0.29 | | 0.13 | | |
| BDL122 | 7513.1 | Av. | | | | | | 1.15 | | 1.13 | | |
| BDL122 | 7513.1 | P | | | | | | | | 0.18 | | |
| BDL122 | 7513.1 | Av. | | | | | | | | 1.22 | | |
| BDL122 | 7513.14 | P | 0.31 | | 0.14 | | | 0.01 | | 0.10 | 0.00 | |
| BDL122 | 7513.14 | Av. | 1.18 | | 1.25 | | | 1.37 | | 1.13 | 1.08 | |
| BDL122 | 7513.9 | P | 0.48 | | 0.21 | | | | | | 0.01 | |
| BDL122 | 7513.9 | Av. | 5.25 | | 1.14 | | | | | | 1.10 | |
| BDL122 | 7514.3 | P | 0.53 | | | | | | | 0.51 | | |
| BDL122 | 7514.3 | Av. | 4.19 | | | | | | | 1.20 | | |
| BDL122 | 7513.1 | P | | | | | 0.33 | | | | | 0.47 |
| BDL122 | 7513.1 | Av. | | | | | 1.16 | | | | | 1.14 |
| BDL122 | 7513.14 | P | | | | | | | | | | |
| BDL122 | 7513.14 | Av. | | | | | | | | | | |
| BDL122 | 7513.9 | P | | | | | | | | | | |
| BDL122 | 7513.9 | Av. | | | | | | | | | | |
| BDL122 | 7514.3 | P | | | | | | | | | | |
| BDL122 | 7514.3 | Av. | | | | | | | | | | |
| BDL123 | 8082.1 | P | 0.00 | | | | | 0.49 | | | | |
| BDL123 | 8082.1 | Av. | 1.30 | | | | | 1.21 | | | | |
| BDL123 | 8082.3 | P | | | | | | 0.03 | | | | |
| BDL123 | 8082.3 | Av. | | | | | | 1.24 | | | | |
| BDL123 | 8082.6 | P | 0.68 | | | | | 0.13 | | | | |
| BDL123 | 8082.6 | Av. | 1.17 | | | | | 1.21 | | | | |
| BDL123 | 8083.2 | P | 0.50 | | 0.28 | 0.26 | | 0.07 | | | | |
| BDL123 | 8083.2 | Av. | 9.06 | | 1.38 | 1.15 | | 1.32 | | | | |
| BDL123 | 8083.3 | P | | | | 0.07 | | | | | | |
| BDL123 | 8083.3 | Av. | | | | 1.03 | | | | | | |

TABLE 27-continued

| | | | | | | | | | | | | |
|---|---|---|---|---|---|---|---|---|---|---|---|---|
| BDL124 | 8482.1 | P | | 0.01 | 0.13 | 0.22 | | | | | | |
| BDL124 | 8482.1 | Av. | | 1.12 | 1.30 | 1.29 | | | | | | |
| BDL125 | 7491.1 | P | | | | | | 0.04 | | | | |
| BDL125 | 7491.1 | Av. | | | | | | 1.23 | | | | |
| BDL125 | 7491.5 | P | 0.05 | | | | | | | | | |
| BDL125 | 7491.5 | Av. | 1.16 | | | | | | | | | |
| BDL125 | 7492.5 | P | | | 0.02 | 0.00 | | 0.40 | | | 0.06 | |
| BDL125 | 7492.5 | Av. | | | 1.21 | 1.13 | | 1.23 | | | 1.04 | |
| BDL125 | 7494.1 | P | | 0.20 | 0.00 | 0.00 | | | | | | |
| BDL125 | 7494.1 | Av. | | 1.10 | 1.17 | 1.09 | | | | | | |
| BDL125 | 7495.5 | P | | | 0.06 | 0.00 | | 0.28 | | | | |
| BDL125 | 7495.5 | Av. | | | 1.14 | 1.09 | | 1.20 | | | | |
| BDL128 | 7711.3 | P | 0.85 | 0.53 | 0.18 | 0.00 | | 0.24 | | | | |
| BDL128 | 7711.3 | Av. | 1.12 | 1.13 | 1.29 | 1.15 | | 1.20 | | | | |
| BDL128 | 8361.5 | P | 0.53 | 0.43 | 0.26 | | | 0.30 | | | 0.05 | |
| BDL128 | 8361.5 | Av. | 3.76 | 1.14 | 1.16 | | | 1.12 | | | 1.04 | |
| BDL128 | 8362.2 | P | | | 0.26 | 0.02 | | 0.01 | | 0.31 | 0.04 | |
| BDL128 | 8362.2 | Av. | | | 1.12 | 1.08 | | 1.36 | | 1.23 | 1.11 | |
| BDL128 | 8363.2 | P | | | | | | 0.16 | | 0.41 | 0.06 | |
| BDL128 | 8363.2 | Av. | | | | | | 1.14 | | 1.24 | 1.11 | |
| BDL128 | 8365.2 | P | 0.48 | | 0.06 | 0.00 | | 0.01 | | | | |
| BDL128 | 8365.2 | Av. | 5.56 | | 1.43 | 1.17 | | 1.42 | | | | |
| BDL129 | 7691.4 | P | | | 0.05 | 0.00 | | | | | 0.04 | |
| BDL129 | 7691.4 | Av. | | | 1.17 | 1.15 | | | | | 1.08 | |
| BDL129 | 7691.6 | P | 0.16 | | 0.33 | 0.12 | | | | | | |
| BDL129 | 7691.6 | Av. | 1.34 | | 1.26 | 1.16 | | | | | | |
| BDL129 | 7692.2 | P | 0.51 | | 0.42 | | | | | | | |
| BDL129 | 7692.2 | Av. | 6.06 | | 1.15 | | | | | | | |
| BDL129 | 7692.6 | P | | | | | | | | | | |
| BDL129 | 7692.6 | Av. | | | | | | | | | | |
| BDL129 | 7693.1 | P | 0.50 | | 0.00 | | | | | 0.17 | | |
| BDL129 | 7693.1 | Av. | 6.16 | | 1.21 | | | | | 1.14 | | |
| BDL130 | 7663.1 | P | 0.08 | | | | 0.33 | | | 0.03 | | |
| BDL130 | 7663.1 | Av. | 1.14 | | | | 1.16 | | | 1.13 | | |
| BDL130 | 7663.3 | P | 0.01 | 0.19 | 0.03 | 0.13 | | | | | | |
| BDL130 | 7663.3 | Av. | 1.41 | 1.13 | 1.35 | 1.28 | | | | | | |
| BDL130 | 7663.6 | P | | | | | | | | | | |
| BDL130 | 7663.6 | Av. | | | | | | | | | | |
| BDL130 | 7664.5 | P | | | | | | | | | | |
| BDL130 | 7664.5 | Av. | | | | | | | | | | |
| BDL131 | 7461.2 | P | 0.00 | | | | | 0.17 | | | | |
| BDL131 | 7461.2 | Av. | 1.30 | | | | | 1.25 | | | | |
| BDL131 | 7461.4 | P | | | | | | 0.16 | | | | |
| BDL131 | 7461.4 | Av. | | | | | | 1.17 | | | | |
| BDL131 | 7462.2 | P | | | | | | | | | | |
| BDL131 | 7462.2 | Av. | | | | | | | | | | |
| BDL131 | 7463.4 | P | 0.16 | | | 0.00 | | | | | | |
| BDL131 | 7463.4 | Av. | 1.21 | | | 1.09 | | | | | | |
| BDL131 | 7464.5 | P | 0.06 | | 0.00 | 0.03 | | 0.11 | | | | |
| BDL132 | 7464.5 | Av. | 1.14 | | 1.27 | 1.15 | | 1.16 | | | | |
| BDL132 | 7471.1 | P | | | | | | | | | | |
| BDL132 | 7471.1 | Av. | | | | | | | | | | |
| BDL132 | 7471.4 | P | | | | | | 0.60 | | | | |
| BDL132 | 7471.4 | Av. | | | | | | 1.27 | | | | |
| BDL132 | 7472.4 | P | | | 0.02 | | | | | | | |
| BDL132 | 7472.4 | Av. | | | 1.17 | | | | | | | |
| BDL132 | 7473.1 | P | 0.46 | | | | | | | | | |
| BDL132 | 7473.1 | Av. | 4.79 | | | | | | | | | |
| BDL132 | 7474.4 | P | 0.51 | | 0.06 | 0.04 | | | | | | |
| BDL132 | 7474.4 | Av. | 5.70 | | 1.28 | 1.15 | | | | | | |
| BDL132 | 7471.1 | P | | | | | | | | | | |
| BDL132 | 7471.1 | Av. | | | | | | | | | | |
| BDL132 | 7471.4 | P | | | | | 0.41 | | | | | |
| BDL132 | 7471.4 | Av. | | | | | 1.25 | | | | | |
| BDL132 | 7472.4 | P | | 0.10 | | | 0.57 | | | | | 0.81 |
| BDL132 | 7472.4 | Av. | | 1.09 | | | 1.34 | | | | | 1.14 |
| BDL132 | 7473.1 | P | | 0.28 | | | | | | | | 0.21 |
| BDL132 | 7473.1 | Av. | | 1.23 | | | | | | | | 1.11 |
| BDL132 | 7475.4 | P | | | | | | | | | | |
| BDL132 | 7475.4 | Av. | | | | | | | | | | |
| BDL133 | 8161.1 | P | | | | | | | | | | |
| BDL133 | 8161.1 | Av. | | | | | | | | | | |
| BDL133 | 8161.2 | P | | | | | | | | | | |
| BDL133 | 8161.2 | Av. | | | | | | | | | | |
| BDL133 | 8161.3 | P | 0.63 | | | | 0.32 | 0.02 | | 0.15 | | |
| BDL133 | 8161.3 | Av. | 1.13 | | | | 1.11 | 1.21 | | 1.16 | | |
| BDL133 | 8161.4 | P | | 0.24 | 0.05 | 0.04 | 0.43 | | | | | |
| BDL133 | 8161.4 | Av. | | 1.13 | 1.08 | 1.12 | 1.17 | | | | | |
| BDL133 | 8162.1 | P | | | 0.42 | 0.01 | | | | | | |
| BDL133 | 8162.1 | Av. | | | 1.10 | 1.13 | | | | | | |

TABLE 27-continued

| | | | | | | | | | | | |
|---|---|---|---|---|---|---|---|---|---|---|---|
| BDL133 | 8162.3 | P | | | 0.03 | 0.04 | | | | 0.58 | |
| BDL133 | 8162.3 | Av. | | | 1.09 | 1.07 | | | | 1.34 | |
| BDL133 | 8162.5 | P | 0.02 | | | | 0.10 | | | 0.06 | |
| BDL133 | 8162.5 | Av. | 1.20 | | | | 1.16 | | | 1.25 | |
| BDL133 | 8163.2 | P | | | | | 0.51 | | | 0.27 | |
| BDL133 | 8163.2 | Av. | | | | | 1.13 | | | 1.27 | |
| BDL134 | 7671.2 | P | | 0.26 | 0.11 | 0.01 | | | | | |
| BDL134 | 7671.2 | Av. | | 1.15 | 1.21 | 1.17 | | | | | |
| BDL134 | 7672.1 | P | 0.08 | | 0.05 | 0.05 | 0.50 | | | 0.00 | |
| BDL134 | 7672.1 | Av. | 1.26 | | 1.08 | 1.10 | 1.12 | | | 1.25 | |
| BDL134 | 7673.1 | P | 0.07 | | 0.02 | | | | | 0.02 | |
| BDL134 | 7673.1 | Av. | 1.14 | | 1.23 | | | | | 1.13 | |
| BDL134 | 7673.2 | P | 0.15 | | 0.00 | 0.00 | | | | | |
| BDL134 | 7673.2 | Av. | 1.18 | | 1.16 | 1.10 | | | | | |
| BDL135 | 7722.1 | P | 0.29 | | | | | | | | |
| BDL135 | 7722.1 | Av. | 1.16 | | | | | | | | |
| BDL135 | 7723.1 | P | 0.03 | | | | | | | | |
| BDL135 | 7723.1 | Av. | 1.18 | | | | | | | | |
| BDL135 | 7723.3 | P | | | | 0.21 | | | | 0.40 | |
| BDL135 | 7723.3 | Av. | | | | 1.22 | | | | 1.15 | |
| BDL135 | 7723.8 | P | 0.25 | | | 0.01 | | | | | |
| BDL135 | 7723.8 | Av. | 1.12 | | | 1.10 | | | | | |
| BDL135 | 7723.9 | P | | | | | 0.55 | | | 0.47 | 0.09 |
| BDL135 | 7723.9 | Av. | | | | | 1.20 | | | 1.15 | 1.03 |
| BDL136 | 7751.4 | P | 0.13 | | | | | | | 0.01 | |
| BDL136 | 7751.4 | Av. | 1.12 | | | | | | | 1.18 | |
| BDL136 | 7751.5 | P | 0.24 | | 0.02 | 0.01 | 0.33 | | | | |
| BDL136 | 7751.5 | Av. | 1.11 | | 1.10 | 1.08 | 1.10 | | | | |
| BDL136 | 7751.8 | P | | | | | 0.00 | | | | |
| BDL136 | 7751.8 | Av. | | | | | 1.24 | | | | |
| BDL136 | 7752.6 | P | | | 0.06 | 0.21 | | | | | |
| BDL136 | 7752.6 | Av. | | | 1.20 | 1.11 | | | | | |
| BDL137 | 7701.2 | P | 0.13 | | | | 0.27 | | | | |
| BDL137 | 7701.2 | Av. | 1.25 | | | | 1.10 | | | | |
| BDL137 | 7701.5 | P | | | 0.01 | 0.10 | | | 0.62 | | |
| BDL137 | 7701.5 | Av. | | | 1.22 | 1.15 | | | 1.13 | | |
| BDL137 | 7701.6 | P | 0.55 | | | | | 0.77 | | | |
| BDL137 | 7701.6 | Av. | 1.11 | | | | | 1.11 | | | |
| BDL137 | 7702.1 | P | 0.17 | 0.25 | 0.07 | 0.15 | | | | | |
| BDL137 | 7702.1 | Av. | 1.25 | 1.13 | 1.24 | 1.19 | | | | | |
| BDL137 | 7703.2 | P | | | | | | | | 0.37 | |
| BDL137 | 7703.2 | Av. | | | | | | | | 1.15 | |
| BDL137 | 7703.3 | P | 0.67 | 0.22 | 0.00 | 0.14 | 0.48 | | | | |
| BDL137 | 7703.3 | Av. | 1.11 | 1.15 | 1.27 | 1.16 | 1.17 | | | | |
| BDL137 | 7703.7 | P | 0.02 | | 0.06 | 0.18 | | | | | |
| BDL137 | 7703.7 | Av. | 1.21 | | 1.23 | 1.13 | | | | | |
| BDL139 | 8131.1 | P | | | | | | | | | |
| BDL139 | 8131.1 | Av. | | | | | | | | | |
| BDL139 | 8131.2 | P | 0.56 | | 0.08 | 0.02 | | | 0.10 | | |
| BDL139 | 8131.2 | Av. | 1.13 | | 1.15 | 1.15 | | | 1.19 | | |
| BDL139 | 8132.7 | P | | | | | | | | | |
| BDL139 | 8132.7 | Av. | | | | | | | | | |
| BDL139 | 8133.2 | P | | | | | | | | | |
| BDL139 | 8133.2 | Av. | | | | | | | | | |
| BDL141 | 8141.2 | P | | | 0.15 | 0.05 | | | | | |
| BDL141 | 8141.2 | Av. | | | 1.11 | 1.12 | | | | | |
| BDL141 | 8142.2 | P | | | | | | | | | |
| BDL141 | 8142.2 | Av. | | | | | | | | | |
| BDL142 | 8282.1 | P | 0.20 | | 0.01 | 0.00 | 0.68 | | | | |
| BDL142 | 8282.1 | Av. | 1.14 | | 1.24 | 1.19 | 1.11 | | | | |
| BDL142 | 8283.1 | P | 0.11 | | | | | | | | |
| BDL142 | 8283.1 | Av. | 1.16 | | | | | | | | |
| BDL142 | 8283.2 | P | 0.30 | | | | | 0.32 | | 0.43 | |
| BDL142 | 8283.2 | Av. | 1.18 | | | | | 1.12 | | 1.20 | |
| BDL142 | 8284.1 | P | 0.41 | | | | | | | | |
| BDL142 | 8284.1 | Av. | 1.16 | | | | | | | | |
| BDL142 | 8285.3 | P | 0.41 | 0.44 | 0.00 | 0.00 | | | 0.63 | | |
| BDL142 | 8285.3 | Av. | 1.22 | 1.16 | 1.27 | 1.16 | | | 1.12 | | |
| BDL142 | 8285.5 | P | | | | | 0.49 | | | | |
| BDL142 | 8285.5 | Av. | | | | | 1.13 | | | | |
| BDL143 | 8411.1 | P | | | | | | | | | |
| BDL143 | 8411.1 | Av. | | | | | | | | | |
| BDL143 | 8411.5 | P | 0.54 | | | 0.03 | | 0.38 | 0.24 | | |
| BDL143 | 8411.5 | Av. | 1.13 | | | 1.08 | | 1.10 | 1.21 | | |
| BDL143 | 8412.2 | P | 0.03 | | 0.03 | 0.00 | | | | | 0.05 |
| BDL143 | 8412.2 | Av. | 1.22 | | 1.32 | 1.24 | | | | | 1.03 |
| BDL143 | 8412.4 | P | | 0.47 | 0.00 | 0.00 | | | | | |
| BDL143 | 8412.4 | Av. | | 1.18 | 1.37 | 1.29 | | | | | |
| BDL143 | 8413.3 | P | 0.18 | | 0.24 | 0.05 | | | | | |
| BDL143 | 8413.3 | Av. | 1.11 | | 1.18 | 1.16 | | | | | |

TABLE 27-continued

| | | | | | | | | | | | | |
|---|---|---|---|---|---|---|---|---|---|---|---|---|
| BDL143 | 8414.4 | P | | | 0.16 | 0.00 | | | | | | |
| BDL143 | 8414.4 | Av. | | | 1.11 | 1.18 | | | | | | |
| BDL143 | 8414.5 | P | | | 0.11 | 0.01 | | | | | | |
| BDL143 | 8414.5 | Av. | | | 1.23 | 1.19 | | | | | | |
| BDL144 | 8384.1 | P | 0.18 | | 0.03 | 0.00 | | | | | 0.03 | |
| BDL144 | 8384.1 | Av. | 1.13 | | 1.29 | 1.21 | | | | | 1.03 | |
| BDL144 | 8384.5 | P | | 0.14 | 0.00 | 0.01 | | | | | | |
| BDL144 | 8384.5 | Av. | | 1.20 | 1.33 | 1.32 | | | | | | |
| BDL144 | 8385.1 | P | 0.40 | 0.05 | 0.12 | 0.04 | | | | | | |
| BDL144 | 8385.1 | Av. | 1.24 | 1.20 | 1.44 | 1.33 | | | | | | |
| BDL145 | 8233.2 | P | 0.13 | | | | | | | | | |
| BDL145 | 8233.2 | Av. | 1.23 | | | | | | | | | |
| BDL145 | 8233.3 | P | 0.58 | 0.56 | 0.11 | 0.10 | | | | | | |
| BDL145 | 8233.3 | Av. | 1.15 | 1.12 | 1.27 | 1.21 | | | | | | |
| BDL145 | 8235.1 | P | | | 0.05 | 0.17 | 0.19 | | | | | |
| BDL145 | 8235.1 | Av. | | | 1.08 | 1.12 | 1.10 | | | | | |
| BDL145 | 8235.3 | P | | 0.29 | 0.02 | 0.03 | | | | | | |
| BDL145 | 8235.3 | Av. | | 1.20 | 1.21 | 1.15 | | | | | | |
| BDL145 | 8235.4 | P | | | | | | | | | | |
| BDL145 | 8235.4 | Av. | | | | | | | | | | |
| BDL146 | 8241.1 | P | | | | | | | | | | |
| BDL146 | 8241.1 | Av. | | | | | | | | | | |
| BDL146 | 8241.3 | P | | 0.00 | 0.00 | 0.00 | 0.47 | | | 0.02 | | |
| BDL146 | 8241.3 | Av. | | 1.17 | 1.16 | 1.15 | 1.11 | | | 1.15 | | |
| BDL146 | 8243.2 | P | 0.20 | | 0.00 | 0.02 | | | | | | |
| BDL146 | 8243.2 | Av. | 1.14 | | 1.20 | 1.15 | | | | | | |
| BDL146 | 8243.5 | P | 0.03 | | 0.10 | 0.01 | | | | | | |
| BDL146 | 8243.5 | Av. | 1.23 | | 1.19 | 1.10 | | | | | | |
| BDL146 | 8244.4 | P | 0.08 | | | | 0.17 | | | | | |
| BDL146 | 8244.4 | Av. | 1.16 | | | | 1.17 | | | | | |
| BDL146 | 8244.7 | P | 0.15 | | 0.04 | 0.15 | | | | | | |
| BDL146 | 8244.7 | Av. | 1.14 | | 1.18 | 1.19 | | | | | | |
| BDL146 | 8245.2 | P | 0.03 | | | | | | 0.38 | | | |
| BDL146 | 8245.2 | Av. | 1.18 | | | | | | 1.35 | | | |
| BDL146 | 8245.5 | P | | | | | 0.20 | 0.22 | | 0.06 | | |
| BDL146 | 8245.5 | Av. | | | | | 1.24 | 1.21 | | 1.44 | | |
| BDL42 | 7771.1 | P | | | | | | | | | | |
| BDL42 | 7771.1 | Av. | | | | | | | | | | |
| BDL42 | 7772.1 | P | | | | | | | | | | |
| BDL42 | 7772.1 | Av. | | | | | | | | | | |
| BDL42 | 7772.7 | P | | | | | | | | | | |
| BDL42 | 7772.7 | Av. | | | | | | | | | | |
| BDL42 | 7774.1 | P | | 0.06 | 0.00 | 0.01 | | | | | | |
| BDL42 | 7774.1 | Av. | | 1.11 | 1.31 | 1.27 | | | | | | |
| BDL42 | 7774.2 | P | | | | | | | | | | |
| BDL42 | 7774.2 | Av. | | | | | | | | | | |
| BDL42 | 7774.4 | P | | | 0.06 | 0.21 | | | | | | |
| BDL42 | 7774.4 | Av. | | | 1.36 | 1.21 | | | | | | |
| BDL46 | 7833.3 | P | 0.19 | | 0.16 | 0.00 | | 0.54 | | | | |
| BDL46 | 7833.3 | Av. | 1.36 | | 1.30 | 1.15 | | 1.15 | | | | |
| BDL46 | 7833.4 | P | | | | | | 0.00 | | | | |
| BDL46 | 7833.4 | Av. | | | | | | 1.40 | | | | |
| BDL46 | 7833.5 | P | | | 0.04 | 0.07 | | 0.19 | | | | |
| BDL46 | 7833.5 | Av. | | | 1.14 | 1.03 | | 1.15 | | | | |
| BDL46 | 7833.6 | P | 0.61 | | 0.63 | | | 0.22 | | | | |
| BDL46 | 7833.6 | Av. | 1.19 | | 1.16 | | | 1.52 | | | | |
| BDL46 | 7834.1 | P | | | 0.33 | 0.00 | | | | | 0.01 | |
| BDL46 | 7834.1 | Av. | | | 1.15 | 1.09 | | | | | 1.07 | |
| BDL46 | 7833.1 | P | 0.02 | | | | 0.12 | | | | | 0.02 |
| BDL46 | 7833.1 | Av. | 1.18 | | | | 1.12 | | | | | 1.14 |
| BDL46 | 7833.3 | P | | | | | | | | | | |
| BDL46 | 7833.3 | Av. | | | | | | | | | | |
| BDL46 | 7833.4 | P | | | | | 0.73 | | | | | 0.75 |
| BDL46 | 7833.4 | Av. | | | | | 1.25 | | | | | 1.25 |
| BDL46 | 7833.5 | P | | | | | | | | | | |
| BDL46 | 7833.5 | Av. | | | | | | | | | | |
| BDL46 | 7834.4 | P | | 0.02 | | | | | | | | |
| BDL46 | 7834.4 | Av. | | 1.29 | | | | | | | | |
| BDL51 | 7291.1 | P | | | 0.04 | 0.01 | | | | | 0.00 | |
| BDL51 | 7291.1 | Av. | | | 1.22 | 1.09 | | | | | 1.13 | |
| BDL51 | 8021.1 | P | 0.50 | 0.13 | 0.10 | 0.11 | | | | | | |
| BDL51 | 8021.1 | Av. | 26.01 | 1.15 | 1.69 | 1.24 | | | | | | |
| BDL51 | 8022.4 | P | 0.34 | | 0.18 | 0.00 | | | | | | |
| BDL51 | 8022.4 | Av. | 1.54 | | 1.41 | 1.19 | | | | | | |
| BDL51 | 8022.5 | P | | 0.03 | 0.11 | 0.01 | | | | | 0.07 | |
| BDL51 | 8022.5 | Av. | | 1.43 | 1.26 | 1.14 | | | | | 1.05 | |
| BDL51 | 8024.4 | P | 0.53 | 0.30 | 0.49 | | | | | | | |
| BDL51 | 8024.4 | Av. | 1.30 | 1.15 | 1.14 | | | | | | | |
| BDL51 | 8024.7 | P | 0.41 | | | | | 0.35 | | | | |
| BDL51 | 8024.7 | Av. | 1.21 | | | | | 1.24 | | | | |

TABLE 27-continued

| | | | | | | | | | | | | |
|---|---|---|---|---|---|---|---|---|---|---|---|---|
| BDL52 | 7861.1 | P | | | | | | 0.30 | | | | |
| BDL52 | 7861.1 | Av. | | | | | | 1.38 | | | | |
| BDL52 | 7861.5 | P | 0.01 | | 0.36 | 0.10 | | | | | | |
| BDL52 | 7861.5 | Av. | 1.27 | | 1.17 | 1.12 | | | | | | |
| BDL52 | 7863.2 | P | | | | 0.07 | | | | 0.14 | 0.02 | |
| BDL52 | 7863.2 | Av. | | | | 1.03 | | | | 1.11 | 1.09 | |
| BDL52 | 7864.5 | P | 0.71 | | | | | 0.39 | | | | |
| BDL52 | 7864.5 | Av. | 1.10 | | | | | 1.35 | | | | |
| BDL54 | 7781.1 | P | 0.50 | | 0.01 | 0.00 | | | | | | |
| BDL54 | 7781.1 | Av. | 6.59 | | 1.12 | 1.09 | | | | | | |
| BDL54 | 7781.4 | P | 0.27 | | | 0.00 | | 0.50 | | | | |
| BDL54 | 7781.4 | Av. | 1.19 | | | 1.09 | | 1.31 | | | | |
| BDL54 | 7784.3 | P | 0.48 | 0.05 | 0.00 | 0.05 | | 0.22 | | | | |
| BDL54 | 7784.3 | Av. | 5.77 | 1.15 | 1.35 | 1.15 | | 1.12 | | | | |
| BDL54 | 7784.5 | P | 0.47 | | 0.23 | | | 0.75 | | | | |
| BDL54 | 7784.5 | Av. | 1.19 | | 1.15 | | | 1.12 | | | | |
| BDL54 | 7785.4 | P | 0.36 | | 0.25 | 0.15 | | 0.16 | | | | |
| BDL54 | 7785.4 | Av. | 1.22 | | 1.16 | 1.12 | | 1.20 | | | | |
| BDL54 | 7781.1 | P | | 0.23 | | | | | | | | |
| BDL54 | 7781.1 | Av. | | 1.13 | | | | | | | | |
| BDL54 | 7781.4 | P | | 0.52 | | | | | | | | 0.15 |
| BDL54 | 7781.4 | Av. | | 1.18 | | | | | | | | 1.19 |
| BDL54 | 7784.3 | P | | 0.02 | | | | | | | | |
| BDL54 | 7784.3 | Av. | | 1.14 | | | | | | | | |
| BDL54 | 7785.4 | P | | | | | 0.34 | | | | | 0.26 |
| BDL54 | 7785.4 | Av. | | | | | 1.18 | | | | | 1.20 |
| BDL54 | 7785.8 | P | | | | | | | | | | 0.32 |
| BDL54 | 7785.8 | Av. | | | | | | | | | | 1.21 |
| BDL56 | 7181.2 | P | 0.50 | | 0.00 | 0.00 | | 0.70 | | | | |
| BDL56 | 7181.2 | Av. | 3.28 | | 1.42 | 1.19 | | 1.13 | | | | |
| BDL56 | 8301.1 | P | | | | 0.01 | | 0.05 | | | | |
| BDL56 | 8301.1 | Av. | | | | 1.05 | | 1.24 | | | | |
| BDL56 | 8301.3 | P | 0.64 | | | | | | | | | |
| BDL56 | 8301.3 | Av. | 1.15 | | | | | | | | | |
| BDL56 | 8304.1 | P | | | | | | | | | | |
| BDL56 | 8304.1 | Av. | | | | | | | | | | |
| BDL56 | 8305.1 | P | 0.71 | | | | | 0.23 | | | | |
| BDL56 | 8305.1 | Av. | 1.13 | | | | | 1.20 | | | | |
| BDL56 | 8301.1 | P | | 0.41 | | | | | | | | |
| BDL56 | 8301.1 | Av. | | 1.15 | | | | | | | | |
| BDL56 | 8301.2 | P | | 0.01 | | | | | | | | 0.07 |
| BDL56 | 8301.2 | Av. | | 1.17 | | | | | | | | 1.10 |
| BDL56 | 8301.3 | P | | | | | | | | | | 0.25 |
| BDL56 | 8301.3 | Av. | | | | | | | | | | 1.11 |
| BDL56 | 8303.1 | P | | | | | | | | | | |
| BDL56 | 8303.1 | Av. | | | | | | | | | | |
| BDL56 | 8303.2 | P | | | | | 0.57 | | | | | |
| BDL56 | 8303.2 | Av. | | | | | 1.11 | | | | | |
| BDL56 | 7792.1 | P | | | 0.02 | | | | | | | |
| BDL59 | 7792.1 | Av. | | | 1.10 | | | | | | | |
| BDL59 | 7792.2 | P | | | | | | | | | | |
| BDL59 | 7792.2 | Av. | | | | | | | | | | |
| BDL59 | 7792.3 | P | | | | 0.04 | | | | | | |
| BDL59 | 7792.3 | Av. | | | | 1.06 | | | | | | |
| BDL59 | 7793.3 | P | 0.56 | | 0.36 | | | 0.20 | | | | |
| BDL59 | 7793.3 | Av. | 1.11 | | 1.24 | | | 1.14 | | | | |
| BDL59 | 7794.1 | P | 0.01 | | 0.02 | 0.00 | | | | | | |
| BDL59 | 7794.1 | Av. | 6.46 | | 1.13 | 1.09 | | | | | | |
| BDL60 | 8011.4 | P | | | 0.29 | | | 0.03 | | 0.12 | | |
| BDL60 | 8011.4 | Av. | | | 1.13 | | | 1.24 | | 1.15 | | |
| BDL60 | 8011.7 | P | 0.48 | | 0.15 | 0.04 | | 0.38 | | 0.04 | | |
| BDL60 | 8011.7 | Av. | 5.59 | | 1.37 | 1.18 | | 1.11 | | 1.18 | | |
| BDL60 | 8013.4 | P | 0.50 | 0.38 | 0.06 | 0.00 | | 0.60 | | | | |
| BDL60 | 8013.4 | Av. | 27.18 | 1.13 | 1.56 | 1.19 | | 1.15 | | | | |
| BDL60 | 8013.6 | P | 0.62 | 0.14 | 0.00 | 0.08 | | | | | | |
| BDL60 | 8013.6 | Av. | 1.18 | 1.10 | 1.53 | 1.19 | | | | | | |
| BDL60 | 8014.5 | P | | | 0.07 | 0.08 | | | | | | |
| BDL60 | 8014.5 | Av. | | | 1.38 | 1.17 | | | | | | |
| BDL60 | 8013.6 | P | | 0.02 | | | | | | | | |
| BDL60 | 8013.6 | Av. | | 1.12 | | | | | | | | |
| BDL60 | 8014.2 | P | | | | | | | | | | |
| BDL60 | 8014.2 | Av. | | | | | | | | | | |
| BDL60 | 8014.7 | P | 0.07 | | | | | | | | | |
| BDL60 | 8014.7 | Av. | 1.22 | | | | | | | | | |
| BDL60 | 8014.8 | P | | 0.14 | | | 0.25 | | | | | 0.10 |
| BDL60 | 8014.8 | Av. | | 1.10 | | | 1.16 | | | | | 1.24 |
| BDL65 | 7824.1 | P | | | 0.13 | 0.18 | | | | | | |
| BDL65 | 7824.1 | Av. | | | 1.44 | 1.22 | | | | | | |
| BDL65 | 7825.2 | P | | | 0.00 | 0.05 | | | | | | |
| BDL65 | 7825.2 | Av. | | | 1.27 | 1.14 | | | | | | |

TABLE 27-continued

| | | | | | | | | | | |
|---|---|---|---|---|---|---|---|---|---|---|
| BDL65 | 8473.2 | P | 0.01 | 0.01 | 0.00 | 0.00 | | | | |
| BDL65 | 8473.2 | Av. | 1.27 | 1.22 | 1.25 | 1.18 | | | | |
| BDL65 | 8474.1 | P | | | | 0.01 | | | | |
| BDL65 | 8474.1 | Av. | | | | 1.08 | | | | |
| BDL65 | 7901.5 | P | | | 0.00 | 0.00 | 0.31 | | | 0.02 |
| BDL67 | 7901.5 | Av. | | | 1.29 | 1.15 | 1.13 | | | 1.14 |
| BDL67 | 7902.3 | P | 0.48 | | 0.12 | 0.21 | 0.04 | | | 0.00 |
| BDL67 | 7902.3 | Av. | 5.44 | | 1.36 | 1.13 | 1.40 | | | 1.11 |
| BDL67 | 7902.7 | P | 0.50 | 0.08 | 0.04 | 0.04 | | | 0.44 | 0.00 |
| BDL67 | 7902.7 | Av. | 6.31 | 1.13 | 1.42 | 1.16 | | | 1.16 | 1.11 |
| BDL67 | 7903.3 | P | | | 0.19 | | 0.19 | | | |
| BDL67 | 7903.3 | Av. | | | 1.18 | | 1.46 | | | |
| BDL67 | 7903.5 | P | | 0.00 | 0.00 | 0.13 | | | | |
| BDL67 | 7903.5 | Av. | | 1.26 | 1.34 | 1.13 | | | | |
| BDL68 | 7761.3 | P | 0.49 | | 0.34 | 0.00 | | | | |
| BDL68 | 7761.3 | Av. | 12.65 | | 1.21 | 1.14 | | | | |
| BDL68 | 7761.8 | P | 0.19 | 0.08 | 0.00 | 0.08 | 0.27 | | | |
| BDL68 | 7761.8 | Av. | 1.67 | 1.18 | 1.36 | 1.16 | 1.18 | | | |
| BDL68 | 7761.9 | P | 0.44 | | 0.00 | 0.00 | | | | |
| BDL68 | 7761.9 | Av. | 1.22 | | 1.52 | 1.18 | | | | |
| BDL68 | 7763.2 | P | | 0.02 | 0.00 | 0.04 | 0.29 | | 0.22 | |
| BDL68 | 7763.2 | Av. | | 1.18 | 1.32 | 1.13 | 1.31 | | 1.13 | |
| BDL68 | 7764.1 | P | 0.49 | 0.03 | 0.09 | 0.24 | 0.33 | | | |
| BDL68 | 7764.1 | Av. | 7.93 | 1.16 | 1.47 | 1.17 | 1.13 | | | |
| BDL78 | 7911.11 | P | | | 0.00 | 0.12 | | | | |
| BDL78 | 7911.11 | Av. | | | 1.20 | 1.14 | | | | |
| BDL78 | 7911.8 | P | | 0.07 | 0.05 | 0.08 | | | | |
| BDL78 | 7911.8 | Av. | | 1.07 | 1.12 | 1.13 | | | | |
| BDL78 | 7911.9 | P | 0.06 | | 0.07 | 0.00 | | 0.19 | 0.37 | |
| BDL78 | 7911.9 | Av. | 1.19 | | 1.37 | 1.27 | | 1.22 | 1.12 | |
| BDL78 | 7912.6 | P | 0.20 | | | 0.02 | | 0.37 | | |
| BDL78 | 7912.6 | Av. | 1.19 | | | 1.09 | | 1.11 | | |
| BDL78 | 7913.11 | P | 0.14 | 0.29 | 0.00 | 0.00 | | | | |
| BDL78 | 7913.11 | Av. | 1.13 | 1.11 | 1.19 | 1.15 | | | | |
| BDL78 | 7913.3 | P | | | | | | | 0.03 | 0.04 |
| BDL78 | 7913.3 | Av. | | | | | | | 1.14 | 1.03 |
| BDL78 | 7913.6 | P | 0.09 | | 0.00 | 0.01 | | | | |
| BDL78 | 7913.6 | Av. | 1.21 | | 1.27 | 1.22 | | | | |
| BDL78 | 7913.8 | P | 0.07 | | 0.21 | 0.00 | 0.37 | 0.02 | | |
| BDL78 | 7913.8 | Av. | 1.16 | | 1.25 | 1.16 | 1.11 | 1.19 | | |
| BDL78 | 7913.9 | P | | 0.24 | 0.16 | 0.07 | | | | |
| BDL78 | 7913.9 | Av. | | 1.16 | 1.15 | 1.10 | | | | |
| BDL82 | 7801.1 | P | | 0.05 | 0.07 | 0.02 | 0.63 | | | 0.03 |
| BDL82 | 7801.1 | Av. | | 1.14 | 1.41 | 1.15 | 1.13 | | | 1.07 |
| BDL82 | 7801.3 | P | | | 0.13 | 0.00 | | | | |
| BDL82 | 7801.3 | Av. | | | 1.44 | 1.21 | | | | |
| BDL82 | 7802.2 | P | | | 0.00 | 0.16 | | | | |
| BDL82 | 7802.2 | Av. | | | 1.17 | 1.12 | | | | |
| BDL82 | 7802.3 | P | 0.32 | | 0.13 | 0.00 | | | | |
| BDL82 | 7802.3 | Av. | 1.14 | | 1.30 | 1.16 | | | | |
| BDL82 | 7803.9 | P | 0.54 | | | | 0.28 | | | |
| BDL82 | 7803.9 | Av. | 1.18 | | | | 1.35 | | | |
| BDL89 | 7812.2 | P | | | | | | | | |
| BDL89 | 7812.2 | Av. | | | | | | | | |
| BDL89 | 7812.5 | P | 0.51 | 0.18 | 0.11 | 0.18 | | | | 0.03 |
| BDL89 | 7812.5 | Av. | 5.84 | 1.18 | 1.26 | 1.12 | | | | 1.04 |
| BDL89 | 7814.1 | P | 0.58 | | 0.00 | 0.00 | | | | |
| BDL89 | 7814.1 | Av. | 1.16 | | 1.17 | 1.04 | | | | |
| BDL89 | 7814.4 | P | 0.46 | 0.05 | 0.36 | 0.21 | | | | |
| BDL89 | 7814.4 | Av. | 5.59 | 1.17 | 1.24 | 1.13 | | | | |
| BDL89 | 7814.5 | P | | | 0.02 | 0.05 | 0.00 | | | 0.10 |
| BDL89 | 7814.5 | Av. | | | 1.38 | 1.21 | 1.59 | | | 1.15 |

Table 27.

Example 8

Evaluating Transgenic Arabidopsis Plant Growth Under Abiotic Stress and Nitrogen Deficiency Conditions in Tissue Culture Assay Assay 1: plant growth under osmotic stress [poly (ethylene glycol) (PEG)] in tissue culture conditions—One of the consequences of drought is the induction of osmotic stress in the area surrounding the roots; therefore, in many scientific studies, PEG (e.g., 1.5% PEG8000) is used to simulate the osmotic stress conditions resembling the high osmolarity found during drought stress.

Surface sterilized seeds were sown in basal media [50% Murashige-Skoog medium (MS) supplemented with 0.8% plant agar as solidifying agent] in the presence of Kanamycin (for selecting only transgenic plants). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing 1.5% PEG: 0.5 MS media or Normal growth conditions (0.5 MS media). Each plate contained 5 seedlings of the same transgenic event, and 3-4 different plates (replicates) for each event. For each polynucleotide of the invention at least four independent transformation events were analyzed from each construct. Plants expressing the polynucleotides of the invention were compared to the average measurement of the control plants (empty vector or GUS reporter gene under the same promoter) used in the same experiment.

Assay 2: plant growth at nitrogen deficiency under tissue culture conditions—The present inventors have found the nitrogen use efficiency (NUE) assay to be relevant for the evaluation of the ABST candidate genes, since nitrogen deficiency encourages root elongation, increase of root coverage and allows detecting the potential of the plant to generate a better root system under drought conditions. In addition, there are indications in the literature that biological mechanisms of NUE and drought tolerance are linked (Wesley et al., 2002 Journal of Experiment Botany Vol 53, No. 366, pp. 13-25).

Surface sterilized seeds were sown in basal media [50% Murashige-Skoog medium (MS) supplemented with 0.8% plant agar as solidifying agent] in the presence of Kanamycin (for selecting only transgenic plants). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates with nitrogen-limiting conditions: 0.5 MS media in which the combined nitrogen concentration ($NH_4NO_3$ and $KNO_3$) is 0.75 mM (nitrogen deficient conditions). Each plate contains 5 seedlings of same event, and 3-4 different plates (replicates) for each event. For each polynucleotide of the invention at least four independent transformation events were analyzed from each construct. Plants expressing the polynucleotides of the invention were compared to the average measurement of the control plants (empty vector or GUS reporter under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which included 4 light units (4×150 Watts light bulb) and located in a darkroom, was used for capturing images of plantlets sawn in agar plates.

The image capturing process was repeated every 2-5 days starting at day 1 till day 10-15 (see for example the images in FIGS. 2A-B)

An image analysis system was used, which consists of a personal desktop computer (Intel P4 3.0 GHz processor) and a public domain program—ImageJ 1.39 (Java based image processing program which was developed at the U.S. National Institutes of Health and freely available on the internet at rsbweb (dot) nih (dot) gov/). Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to the following Formulas.

$$\text{Relative growth rate of leaf area}=(\Delta\text{rosette area}/\Delta t)*(1/\text{rosette area}\,t_1) \quad \text{Formula VI:}$$

Δ rosette area is the interval between the current rosette area (measured at $t_2$) and the rosette area measured at the previous day (Area $t_1$)

Δt is the time interval ($t_2$−$t_1$, in days) between the current analyzed image day ($t_2$) and the previous day ($t_1$).

Thus, the relative growth rate of leaf area is in units of 1/day.

$$\text{Relative growth rate of root coverage}=(\Delta\text{root coverage area}/\Delta t)*(1/\text{root coverage area}\,t_1) \quad \text{Formula VII}$$

Δ root coverage area is the interval between the current root coverage area (measured at $t_2$) and the root coverage area measured at the previous day (Area $t_1$)

Δt is the time interval ($t_2$−$t_1$, in days) between the current analyzed image day ($t_2$) and the previous day ($t_1$).

Thus, the relative growth rate of root coverage area is in units of 1/day.

$$\text{Relative growth rate of root length}=(\Delta\text{root length}/\Delta t)*(1/\text{root length}\,t_1) \quad \text{Formula VIII}$$

Δ root length is the interval between the current root length (measured at $t_2$) and the root length measured at the previous day (Area $t_1$)

Δt is the time interval ($t_2$−$t_1$, in days) between the current analyzed image day ($t_2$) and the previous day ($t_1$).

Thus, the relative growth rate of root length is in units of 1/day.

At the end of the experiment, plantlets were removed from the media and weighed for the determination of plant fresh weight. Plantlets were then dried for 24 hours at 60° C., and weighed again to measure plant dry weight for later statistical analysis. Growth rate was determined by comparing the leaf area coverage, root coverage and root length, between each couple of sequential photographs, and results were used to resolve the effect of the gene introduced on plant vigor, under osmotic stress, as well as under optimal conditions. Similarly, the effect of the gene introduced on biomass accumulation, under osmotic stress as well as under optimal conditions, was determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved tolerance to abiotic stresses or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if $p \leq 0.1$. The JMP statistics software package was used (Version 5.2.1, SAS Institute Inc., Cary, N.C., USA).

Experimental Results—The polynucleotide sequences of the invention were assayed for a number of commercially desired traits. Table 28 provides the parameters measured in a tissue culture assay (results are presented in Tables 29 and 30). In cases where a certain event appears more than once, the event was tested in several independent experiments.

TABLE 28

| Parameter symbol used in result Table 29 | Parameter name |
|---|---|
| 1 | Leaf Area time point 1 |
| 2 | Leaf Area time point 2 |
| 3 | Leaf Area time point 3 |
| 4 | Roots Length time point 1 |
| 5 | Roots Length time point 2 |

TABLE 28-continued

| Parameter symbol used in result Table 29 | Parameter name |
|---|---|
| 6 | Roots Length time point 3 |
| 7 | Roots Coverage time point 1 |
| 8 | Roots Coverage time point 2 |
| 9 | Roots Coverage time point 3 |
| 10 | RGR of Leaf Area time point 2 |
| 11 | RGR of Leaf Area time point 3 |
| 12 | RGR of Roots Coverage time point 2 |
| 13 | RGR of Roots Coverage time point 3 |
| 14 | RGR of Roots Length time point 2 |
| 15 | RGR of Roots Length time point 3 |
| 16 | Fresh Weight |
| 17 | Dry Weight |

Table 28.

TABLE 29

| Gene | p.n. SEQ ID NO: | Ev. | Par. | 1 | 2 | 3 | 4 | 5 | 6 | 7 | 8 | 9 |
|---|---|---|---|---|---|---|---|---|---|---|---|---|
| BDL100 | 657 | 7872.2 | P | | | | | | | | | |
| BDL100 | 657 | 7872.2 | Av | | | | | | | | | |
| BDL100 | 657 | 7872.3 | P | | | | | | | | | |
| BDL100 | 657 | 7872.3 | Av | | | | | | | | | |
| BDL100 | 657 | 7873.2 | P | | | | | | | | | |
| BDL100 | 657 | 7873.2 | Av | | | | | | | | | |
| BDL100 | 657 | 7873.4 | P | 0.28 | 0.32 | 0.13 | 0.33 | | | 0.21 | 0.36 | 0.47 |
| BDL100 | 657 | 7873.4 | Av | 1.16 | 1.18 | 1.39 | 1.17 | | | 1.41 | 1.19 | 1.12 |
| BDL51 | 694 | 8021.1 | P | | | | | | | | | |
| BDL51 | 694 | 8021.1 | Av | | | | | | | | | |
| BDL51 | 694 | 8022.4 | P | | | | | | | | | |
| BDL51 | 694 | 8022.4 | Av | | | | | | | | | |
| BDL51 | 694 | 8022.5 | P | | | | | | | | | |
| BDL51 | 694 | 8022.5 | Av | | | | | | | | | |
| BDL51 | 694 | 8024.4 | P | | | | | | | | | |
| BDL51 | 694 | 8024.4 | Av | | | | | | | | | |
| BDL51 | 694 | 8024.7 | P | | | | | | | | | |
| BDL51 | 694 | 8024.7 | Av | | | | | | | | | |
| BDL82 | 704 | 7801.3 | P | | | | | | | | | 0.23 |
| BDL82 | 704 | 7801.3 | Av | | | | | | | | | 1.18 |
| BDL82 | 704 | 7802.2 | P | | | | | | | | | |
| BDL82 | 704 | 7802.2 | Av | | | | | | | | | |
| BDL82 | 704 | 7802.3 | P | | | | | | | | | |
| BDL82 | 704 | 7802.3 | Av | | | | | | | | | |
| BDL82 | 704 | 7803.8 | P | | | | | | | | | |
| BDL82 | 704 | 7803.8 | Av | | | | | | | | | |
| BDL82 | 704 | 7803.9 | P | | | | | | | | | |
| BDL82 | 704 | 7803.9 | Av | | | | | | | | | |
| BDL89 | 705 | 7812.2 | P | | | | | | | | | |
| BDL89 | 705 | 7812.2 | Av | | | | | | | | | |
| BDL89 | 705 | 7812.5 | P | | | | | | | | | |
| BDL89 | 705 | 7812.5 | Av | | | | | | | | | |
| BDL89 | 705 | 7814.1 | P | | | | | | | | | |
| BDL89 | 705 | 7814.1 | Av | | | | | | | | | |
| BDL89 | 705 | 7814.4 | P | | | | | | | | | |
| BDL89 | 705 | 7814.4 | Av | | | | | | | | | |
| BDL89 | 705 | 7814.5 | P | | | | | | | | | |
| BDL89 | 705 | 7814.5 | Av | | | | | | | | | |
| BDL95__Short | 706 | 7841.2 | P | | | | | | | | | |
| BDL95__Short | 706 | 7841.2 | Av | | | | | | | | | |
| BDL95__Short | 706 | 7842.12 | P | | | | | | | | | |
| BDL95__Short | 706 | 7842.12 | Av | | | | | | | | | |
| BDL95__Short | 706 | 7842.2 | P | | | | | | | | | |
| BDL95__Short | 706 | 7842.2 | Av | | | | | | | | | |
| BDL95__Short | 706 | 7842.8 | P | | | | | | | | | |
| BDL95__Short | 706 | 7842.8 | Av | | | | | | | | | |
| BDL95__Short | 706 | 7843.4 | P | | | | | | | | | |
| BDL95__Short | 706 | 7843.4 | Av | | | | | | | | | |
| BDL108 | 659 | 8122.1 | P | | | | | | | | | |
| BDL108 | 659 | 8122.1 | Av | | | | | | | | | |
| BDL108 | 659 | 8122.2 | P | | | | | | | | | |
| BDL108 | 659 | 8122.2 | Av | | | | | | | | | |
| BDL108 | 659 | 8123.6 | P | | | | | | | | | |
| BDL108 | 659 | 8123.6 | Av | | | | | | | | | |
| BDL108 | 659 | 8123.5 | P | | | | | | | | | |
| BDL108 | 659 | 8123.5 | Av | | | | | | | | | |
| BDL59 | 698 | 7792.1 | P | | | | | | | | | |
| BDL59 | 698 | 7792.1 | Av | | | | | | | | | |
| BDL59 | 698 | 7792.2 | P | | | | | | | | | |
| BDL59 | 698 | 7792.2 | Av | | | | | | | | | |

TABLE 29-continued

| | | | | | | | | | | | |
|---|---|---|---|---|---|---|---|---|---|---|---|
| BDL59 | 698 | 7792.3 | P | | | | | | | | |
| BDL59 | 698 | 7792.3 | Av | | | | | | | | |
| BDL59 | 698 | 7793.3 | P | | | | | | | | |
| BDL59 | 698 | 7793.3 | Av | | | | | | | | |
| BDL59 | 698 | 7794.1 | P | | | | | | | | |
| BDL59 | 698 | 7794.1 | Av | | | | | | | | |
| BDL68 | 702 | 7761.3 | P | | | | | | | | |
| BDL68 | 702 | 7761.3 | Av | | | | | | | | |
| BDL68 | 702 | 7761.5 | P | | | | | | | | |
| BDL68 | 702 | 7761.5 | Av | | | | | | | | |
| BDL68 | 702 | 7761.9 | P | | | | | | | | |
| BDL68 | 702 | 7761.9 | Av | | | | | | | | |
| BDL68 | 702 | 7764.1 | P | | | | | | | | |
| BDL68 | 702 | 7764.1 | Av | | | | | | | | |

| Gene | p.n. SEQ ID NO: | Ev. | Par. | 10 | 11 | 12 | 13 | 14 | 15 | 16 | 17 |
|---|---|---|---|---|---|---|---|---|---|---|---|
| BDL100 | 657 | 7872.2 | P | 0.29 | 0.10 | 0.53 | 0.08 | 0.54 | 0.03 | | |
| BDL100 | 657 | 7872.2 | Av | 1.55 | 1.21 | 1.66 | 1.95 | 1.49 | 1.63 | | |
| BDL100 | 657 | 7872.3 | P | 0.60 | 0.08 | | 0.12 | | 0.18 | | |
| BDL100 | 657 | 7872.3 | Av | 1.10 | 1.13 | | 1.71 | | 1.51 | | |
| BDL100 | 657 | 7873.2 | P | 0.41 | 0.12 | | 0.01 | | 0.00 | | |
| BDL100 | 657 | 7873.2 | Av | 1.23 | 1.12 | | 1.61 | | 1.50 | | |
| BDL100 | 657 | 7873.4 | P | | 0.01 | | | | | 0.45 | 0.48 |
| BDL100 | 657 | 7873.4 | Av | | 1.28 | | | | | 1.22 | 1.19 |
| BDL51 | 694 | 8021.1 | P | 0.13 | | 0.02 | | 0.08 | | | |
| BDL51 | 694 | 8021.1 | Av | 1.23 | | 2.20 | | 1.47 | | | |
| BDL51 | 694 | 8022.4 | P | 0.00 | | 0.09 | | 0.05 | | | |
| BDL51 | 694 | 8022.4 | Av | 1.32 | | 1.97 | | 1.49 | | | |
| BDL51 | 694 | 8022.5 | P | 0.08 | | 0.04 | | | | | |
| BDL51 | 694 | 8022.5 | Av | 1.14 | | 1.49 | | | | | |
| BDL51 | 694 | 8024.4 | P | 0.36 | | 0.00 | | 0.16 | | | |
| BDL51 | 694 | 8024.4 | Av | 1.41 | | 2.12 | | 1.55 | | | |
| BDL51 | 694 | 8024.7 | P | 0.34 | | | | | 0.23 | | |
| BDL51 | 694 | 8024.7 | Av | 1.29 | | | | | 1.28 | | |
| BDL82 | 704 | 7801.3 | P | 0.00 | | 0.04 | | 0.00 | | | |
| BDL82 | 704 | 7801.3 | Av | 1.51 | | 2.15 | | 1.67 | | | |
| BDL82 | 704 | 7802.2 | P | | 0.01 | | 0.00 | | 0.01 | | |
| BDL82 | 704 | 7802.2 | Av | | 1.24 | | 2.69 | | 1.98 | | |
| BDL82 | 704 | 7802.3 | P | | 0.02 | | 0.11 | | 0.03 | | |
| BDL82 | 704 | 7802.3 | Av | | 1.24 | | 1.57 | | 1.42 | | |
| BDL82 | 704 | 7803.8 | P | | 0.15 | | 0.16 | | 0.12 | 0.04 | 0.02 |
| BDL82 | 704 | 7803.8 | Av | | 1.29 | | 2.22 | | 1.63 | 1.41 | 1.33 |
| BDL82 | 704 | 7803.9 | P | | | | | | | | |
| BDL82 | 704 | 7803.9 | Av | | | | | | | | |
| BDL89 | 705 | 7812.2 | P | 0.30 | 0.05 | 0.58 | 0.05 | 0.38 | 0.01 | | |
| BDL89 | 705 | 7812.2 | Av | 1.19 | 1.50 | 1.52 | 2.31 | 1.41 | 1.65 | | |
| BDL89 | 705 | 7812.5 | P | | 0.05 | | 0.01 | | 0.00 | | |
| BDL89 | 705 | 7812.5 | Av | | 1.32 | | 3.25 | | 2.10 | | |
| BDL89 | 705 | 7814.1 | P | 0.60 | 0.00 | | 0.24 | | 0.01 | | |
| BDL89 | 705 | 7814.1 | Av | 1.13 | 1.40 | | 2.18 | | 1.70 | | |
| BDL89 | 705 | 7814.4 | P | 0.07 | 0.33 | | 0.07 | | 0.07 | | |
| BDL89 | 705 | 7814.4 | Av | 1.35 | 1.19 | | 1.74 | | 1.52 | | |
| BDL89 | 705 | 7814.5 | P | 0.08 | 0.19 | 0.33 | 0.30 | 0.20 | 0.36 | | |
| BDL89 | 705 | 7814.5 | Av | 1.29 | 1.26 | 1.79 | 1.56 | 1.56 | 1.30 | | |
| BDL95__Short | 706 | 7841.2 | P | 0.14 | | 0.66 | 0.14 | 0.65 | 0.04 | | |
| BDL95__Short | 706 | 7841.2 | Av | 1.22 | | 1.29 | 1.42 | 1.17 | 1.27 | | |
| BDL95__Short | 706 | 7842.12 | P | 0.30 | 0.05 | | 0.04 | | 0.07 | 0.20 | |
| BDL95__Short | 706 | 7842.12 | Av | 1.14 | 1.17 | | 1.36 | | 1.19 | 1.19 | |
| BDL95__Short | 706 | 7842.2 | P | 0.15 | | | 0.29 | | 0.08 | | |
| BDL95__Short | 706 | 7842.2 | Av | 1.45 | | | 1.27 | | 1.28 | | |
| BDL95__Short | 706 | 7842.8 | P | 0.35 | 0.00 | | 0.07 | | 0.07 | | |
| BDL95__Short | 706 | 7842.8 | Av | 1.10 | 1.37 | | 2.82 | | 2.07 | | |
| BDL95__Short | 706 | 7843.4 | P | 0.43 | 0.00 | | 0.01 | | 0.01 | | 0.41 |
| BDL95__Short | 706 | 7843.4 | Av | 1.14 | 1.42 | | 3.00 | | 2.12 | | 1.26 |
| BDL108 | 659 | 8122.1 | P | 0.11 | 0.18 | 0.45 | 0.61 | 0.73 | 0.51 | | |
| BDL108 | 659 | 8122.1 | Av | 1.28 | 1.24 | 1.44 | 1.13 | 1.16 | 1.20 | | |
| BDL108 | 659 | 8122.2 | P | 0.09 | 0.02 | 0.00 | 0.00 | 0.12 | 0.01 | 0.77 | 0.38 |
| BDL108 | 659 | 8122.2 | Av | 1.59 | 1.37 | 1.82 | 2.09 | 1.29 | 1.71 | 1.11 | 1.17 |
| BDL108 | 659 | 8123.6 | P | | 0.59 | 0.57 | 0.40 | | 0.08 | | |
| BDL108 | 659 | 8123.6 | Av | | 1.10 | 1.33 | 1.27 | | 1.53 | | |
| BDL108 | 659 | 8123.5 | P | | 0.04 | | 0.29 | | 0.25 | | |
| BDL108 | 659 | 8123.5 | Av | | 1.14 | | 1.75 | | 1.36 | | |
| BDL59 | 698 | 7792.1 | P | | | | 0.26 | | | | 0.70 |
| BDL59 | 698 | 7792.1 | Av | | | | 1.38 | | | | 1.11 |
| BDL59 | 698 | 7792.2 | P | 0.33 | 0.31 | 0.02 | 0.25 | 0.14 | 0.01 | | |
| BDL59 | 698 | 7792.2 | Av | 1.33 | 1.23 | 1.63 | 1.26 | 1.28 | 1.40 | | |

TABLE 29-continued

| | | | | | | | | | | |
|---|---|---|---|---|---|---|---|---|---|---|
| BDL59 | 698 | 7792.3 | P | | 0.02 | | 0.11 | | 0.29 | |
| BDL59 | 698 | 7792.3 | Av | | 1.36 | | 1.43 | | 1.28 | |
| BDL59 | 698 | 7793.3 | P | 0.06 | 0.32 | 0.30 | 0.16 | 0.11 | 0.05 | |
| BDL59 | 698 | 7793.3 | Av | 1.76 | 1.19 | 1.99 | 1.56 | 1.65 | 1.27 | |
| BDL59 | 698 | 7794.1 | P | | 0.18 | | 0.11 | | 0.13 | |
| BDL59 | 698 | 7794.1 | Av | | 1.15 | | 1.83 | | 1.35 | |
| BDL68 | 702 | 7761.3 | P | 0.32 | | | | | | 0.46 |
| BDL68 | 702 | 7761.3 | Av | 1.15 | | | | | | 1.17 |
| BDL68 | 702 | 7761.5 | P | | 0.40 | 0.15 | 0.21 | 0.14 | 0.20 | |
| BDL68 | 702 | 7761.5 | Av | | 2.43 | 1.86 | 1.58 | 1.60 | 1.42 | |
| BDL68 | 702 | 7761.9 | P | | | | | | | |
| BDL68 | 702 | 7761.9 | Av | | | | | | | |
| BDL68 | 702 | 7764.1 | P | 0.00 | | | 0.53 | | 0.22 | |
| BDL68 | 702 | 7764.1 | Av | 1.44 | | | 1.45 | | 1.61 | |

Table 29. Provided are the growth and biomass parameters of transgenic vs. control plants as measured in Tssue Culture assay under 1.5% PEG.
"P" = P-value;
"Av" = ratio between the averages of event and control. Note that when the average ratio is higher than "1" the effect of exogenous expression of the gene is an increase of the desired trait;
"Par" = Parameter according to the parameters listed in Table 28 above;
"Ev" = event.
"p.n." = polynucleotide.

TABLE 30

| Gene | p.n. SEQ ID NO: | Ev. | Par. | 1 | 2 | 3 | 4 | 5 | 6 | 7 | 8 | 9 |
|---|---|---|---|---|---|---|---|---|---|---|---|---|
| BDL100 | 657 | 7872.2 | P | | | | | | | | | |
| BDL100 | 657 | 7872.2 | Av | | | | | | | | | |
| BDL100 | 657 | 7872.3 | P | | | 0.40 | | | | | | |
| BDL100 | 657 | 7872.3 | Av | | | 1.13 | | | | | | |
| BDL100 | 657 | 7873.2 | P | | | | | | | | | |
| BDL100 | 657 | 7873.2 | Av | | | | | | | | | |
| BDL100 | 657 | 7873.3 | P | | | | | | 0.60 | 0.36 | | 0.56 |
| BDL100 | 657 | 7873.3 | Av | | | | | | 1.15 | 1.12 | | 1.27 |
| BDL100 | 657 | 7873.4 | P | 0.24 | 0.03 | 0.03 | 0.00 | | | 0.01 | | 0.33 |
| BDL100 | 657 | 7873.4 | Av | 1.25 | 1.36 | 1.39 | 1.59 | | | 1.96 | | 1.12 |
| BDL51 | 694 | 8021.1 | P | | | | | | | | | |
| BDL51 | 694 | 8021.1 | Av | | | | | | | | | |
| BDL51 | 694 | 8022.4 | P | | | | | | | 0.51 | | |
| BDL51 | 694 | 8022.4 | Av | | | | | | | 1.31 | | |
| BDL51 | 694 | 8022.5 | P | | | | 0.02 | | | 0.09 | | |
| BDL51 | 694 | 8022.5 | Av | | | | 1.24 | | | 1.30 | | |
| BDL51 | 694 | 8024.4 | P | | | | | | | | | |
| BDL51 | 694 | 8024.4 | Av | | | | | | | | | |
| BDL51 | 694 | 8024.7 | P | | 0.55 | | 0.04 | | 0.09 | 0.05 | | 0.24 |
| BDL51 | 694 | 8024.7 | Av | | 1.11 | | 1.48 | | 1.09 | 2.30 | | 1.12 |
| BDL82 | 704 | 7801.1 | P | | | | | | | | | |
| BDL82 | 704 | 7801.1 | Av | | | | | | | | | |
| BDL82 | 704 | 7801.3 | P | | | | | | | | | |
| BDL82 | 704 | 7801.3 | Av | | | | | | | | | |
| BDL82 | 704 | 7802.2 | P | | | | | | | | | |
| BDL82 | 704 | 7802.2 | Av | | | | | | | | | |
| BDL82 | 704 | 7802.3 | P | | | | | | | 0.52 | | |
| BDL82 | 704 | 7802.3 | Av | | | | | | | 1.14 | | |
| BDL82 | 704 | 7803.8 | P | | | | | | | | | |
| BDL82 | 704 | 7803.8 | Av | | | | | | | | | |
| BDL82 | 704 | 7803.9 | P | | | | | | | | | |
| BDL82 | 704 | 7803.9 | Av | | | | | | | | | |
| BDL89 | 705 | 7812.2 | P | | | | | | | | | |
| BDL89 | 705 | 7812.2 | Av | | | | | | | | | |
| BDL89 | 705 | 7812.5 | P | | | | | | | | | |
| BDL89 | 705 | 7812.5 | Av | | | | | | | | | |
| BDL89 | 705 | 7814.1 | P | | | | | | | | | |
| BDL89 | 705 | 7814.1 | Av | | | | | | | | | |
| BDL89 | 705 | 7814.4 | P | | | | 0.19 | | | 0.30 | | |
| BDL89 | 705 | 7814.4 | Av | | | | 1.19 | | | 1.21 | | |
| BDL89 | 705 | 7814.5 | P | | | | | | | | | 0.42 |
| BDL89 | 705 | 7814.5 | Av | | | | | | | | | 1.11 |
| BDL95__Short | 706 | 7841.2 | P | | | | | | | | | |
| BDL95__Short | 706 | 7841.2 | Av | | | | | | | | | |
| BDL95__Short | 706 | 7842.12 | P | | 0.28 | 0.17 | 0.19 | | | 0.22 | | |
| BDL95__Short | 706 | 7842.12 | Av | | 1.15 | 1.13 | 1.17 | | | 1.26 | | |
| BDL95__Short | 706 | 7842.2 | P | | | | | | | 0.17 | | |
| BDL95__Short | 706 | 7842.2 | Av | | | | | | | 1.32 | | |

TABLE 30-continued

| | | | | | | | | | | | | |
|---|---|---|---|---|---|---|---|---|---|---|---|---|
| BDL95_Short | 706 | 7842.8 | P | | | | | | | | | |
| BDL95_Short | 706 | 7842.8 | Av | | | | | | | | | |
| BDL95_Short | 706 | 7843.4 | P | | | | | | | | | |
| BDL95_Short | 706 | 7843.4 | Av | | | | | | | | | |
| BDL108 | 659 | 8122.1 | P | | | | | | | | | |
| BDL108 | 659 | 8122.1 | Av | | | | | | | | | |
| BDL108 | 659 | 8122.2 | P | | | | | 0.08 | 0.00 | | | 0.08 |
| BDL108 | 659 | 8122.2 | Av | | | | | 1.10 | 1.22 | | | 1.24 |
| BDL108 | 659 | 8123.6 | P | | | | | | | | | |
| BDL108 | 659 | 8123.6 | Av | | | | | | | | | |
| BDL108 | 659 | 8123.5 | P | | | | | | | | | |
| BDL108 | 659 | 8123.5 | Av | | | | | | | | | |
| BDL59 | 698 | 7792.1 | P | | | | | | | | | |
| BDL59 | 698 | 7792.1 | Av | | | | | | | | | |
| BDL59 | 698 | 7792.2 | P | | | | | | | | | |
| BDL59 | 698 | 7792.2 | Av | | | | | | | | | |
| BDL59 | 698 | 7792.3 | P | | | | | | | | | |
| BDL59 | 698 | 7792.3 | Av | | | | | | | | | |
| BDL59 | 698 | 7793.3 | P | | | | | | | | | 0.33 |
| BDL59 | 698 | 7793.3 | Av | | | | | | | | | 1.12 |
| BDL59 | 698 | 7794.1 | P | | | | | | | | | |
| BDL59 | 698 | 7794.1 | Av | | | | | | | | | |
| BDL68 | 702 | 7761.3 | P | | 0.22 | | | | | | | 0.26 |
| BDL68 | 702 | 7761.3 | Av | | 1.20 | | | | | | | 1.15 |
| BDL68 | 702 | 7761.5 | P | | | | | | | | | |
| BDL68 | 702 | 7761.5 | Av | | | | | | | | | |
| BDL68 | 702 | 7761.9 | P | | | | | | | | | |
| BDL68 | 702 | 7761.9 | Av | | | | | | | | | |
| BDL68 | 702 | 7764.1 | P | | | | | | | | | |
| BDL68 | 702 | 7764.1 | Av | | | | | | | | | |

| Gene | p.n. SEQ ID NO: | Ev. | Par. | 10 | 11 | 12 | 13 | 14 | 15 | 16 | 17 |
|---|---|---|---|---|---|---|---|---|---|---|---|
| BDL100 | 657 | 7872.2 | P | 0.16 | 0.11 | | 0.08 | | 0.01 | | |
| BDL100 | 657 | 7872.2 | Av | 1.36 | 1.58 | | 2.18 | | 1.65 | | |
| BDL100 | 657 | 7872.3 | P | | 0.19 | | 0.02 | | 0.03 | | |
| BDL100 | 657 | 7872.3 | Av | | 1.13 | | 1.96 | | 1.60 | | |
| BDL100 | 657 | 7873.2 | P | | 0.03 | | 0.00 | | 0.00 | | |
| BDL100 | 657 | 7873.2 | Av | | 1.52 | | 2.08 | | 1.72 | | |
| BDL100 | 657 | 7873.3 | P | 0.52 | 0.15 | | 0.02 | | 0.01 | | |
| BDL100 | 657 | 7873.3 | Av | 1.12 | 1.23 | | 1.32 | | 1.23 | | |
| BDL100 | 657 | 7873.4 | P | 0.21 | | | 0.23 | | 0.16 | 0.02 | |
| BDL100 | 657 | 7873.4 | Av | 1.18 | | | 1.22 | | 1.13 | 1.42 | |
| BDL51 | 694 | 8021.1 | P | | 0.06 | | 0.00 | | 0.00 | | |
| BDL51 | 694 | 8021.1 | Av | | 1.33 | | 2.61 | | 1.60 | | |
| BDL51 | 694 | 8022.4 | P | | 0.03 | | 0.02 | | 0.14 | | |
| BDL51 | 694 | 8022.4 | Av | | 1.17 | | 2.13 | | 1.46 | | |
| BDL51 | 694 | 8022.5 | P | 0.08 | 0.00 | | 0.02 | | 0.06 | | |
| BDL51 | 694 | 8022.5 | Av | 1.22 | 1.36 | | 2.42 | | 1.75 | | |
| BDL51 | 694 | 8024.4 | P | | 0.00 | | 0.35 | | 0.07 | | |
| BDL51 | 694 | 8024.4 | Av | | 1.32 | | 3.10 | | 1.86 | | |
| BDL51 | 694 | 8024.7 | P | 0.18 | | | 0.38 | | 0.23 | | |
| BDL51 | 694 | 8024.7 | Av | 1.24 | | | 1.19 | | 1.15 | | |
| BDL82 | 704 | 7801.1 | P | | 0.11 | | 0.02 | | 0.14 | | |
| BDL82 | 704 | 7801.1 | Av | | 1.26 | | 3.23 | | 1.76 | | |
| BDL82 | 704 | 7801.3 | P | | 0.13 | | 0.00 | | 0.00 | | |
| BDL82 | 704 | 7801.3 | Av | | 1.27 | | 3.07 | | 1.76 | | |
| BDL82 | 704 | 7802.2 | P | | 0.14 | | 0.01 | | 0.00 | | |
| BDL82 | 704 | 7802.2 | Av | | 1.37 | | 5.55 | | 2.69 | | |
| BDL82 | 704 | 7802.3 | P | | 0.43 | | 0.41 | | 0.50 | | |
| BDL82 | 704 | 7802.3 | Av | | 1.11 | | 1.17 | | 1.17 | | |
| BDL82 | 704 | 7803.8 | P | | | | 0.01 | | 0.00 | | |
| BDL82 | 704 | 7803.8 | Av | | | | 2.16 | | 1.77 | | |
| BDL82 | 704 | 7803.9 | P | | 0.61 | | 0.12 | | 0.01 | | 0.53 |
| BDL82 | 704 | 7803.9 | Av | | 1.11 | | 1.81 | | 1.49 | | 1.14 |
| BDL89 | 705 | 7812.2 | P | 0.29 | 0.00 | | 0.00 | 0.30 | 0.18 | | |
| BDL89 | 705 | 7812.2 | Av | 1.13 | 1.30 | | 1.38 | 1.11 | 1.16 | | |
| BDL89 | 705 | 7812.5 | P | | 0.03 | | 0.02 | | 0.01 | | |
| BDL89 | 705 | 7812.5 | Av | | 1.39 | | 5.28 | | 2.83 | | |
| BDL89 | 705 | 7814.1 | P | | 0.00 | | 0.01 | | 0.00 | | |
| BDL89 | 705 | 7814.1 | Av | | 1.45 | | 1.84 | | 1.38 | | |
| BDL89 | 705 | 7814.4 | P | 0.03 | 0.39 | | 0.01 | | 0.17 | | |
| BDL89 | 705 | 7814.4 | Av | 1.61 | 1.16 | | 1.49 | | 1.14 | | |
| BDL89 | 705 | 7814.5 | P | 0.29 | 0.04 | | 0.00 | | 0.03 | | |
| BDL89 | 705 | 7814.5 | Av | 1.20 | 1.36 | | 1.74 | | 1.59 | | |
| BDL95_Short | 706 | 7841.2 | P | | 0.07 | | 0.00 | | 0.00 | | |
| BDL95_Short | 706 | 7841.2 | Av | | 1.31 | | 2.75 | | 1.81 | | |

TABLE 30-continued

| | | | | | | | | | | | |
|---|---|---|---|---|---|---|---|---|---|---|---|
| BDL95_Short | 706 | 7842.12 | P | 0.44 | | | 0.02 | | 0.11 | 0.43 | 0.64 |
| BDL95_Short | 706 | 7842.12 | Av | 1.14 | | | 1.24 | | 1.16 | 1.25 | 1.11 |
| BDL95_Short | 706 | 7842.2 | P | | 0.19 | | 0.02 | | 0.00 | | |
| BDL95_Short | 706 | 7842.2 | Av | | 1.17 | | 2.06 | | 1.61 | | |
| BDL95_Short | 706 | 7842.8 | P | 0.17 | 0.03 | | 0.00 | | 0.00 | | |
| BDL95_Short | 706 | 7842.8 | Av | 1.14 | 1.18 | | 2.17 | | 1.44 | | |
| BDL95_Short | 706 | 7843.4 | P | | 0.01 | | 0.01 | | 0.00 | | |
| BDL95_Short | 706 | 7843.4 | Av | | 1.67 | | 4.58 | | 2.59 | | |
| BDL108 | 659 | 8122.1 | P | 0.32 | | | 0.31 | | | | |
| BDL108 | 659 | 8122.1 | Av | 1.25 | | | 1.91 | | | | |
| BDL108 | 659 | 8122.2 | P | 0.01 | 0.27 | 0.00 | 0.05 | 0.00 | 0.02 | | |
| BDL108 | 659 | 8122.2 | Av | 2.01 | 1.16 | 1.81 | 1.50 | 1.55 | 1.39 | | |
| BDL108 | 659 | 8123.6 | P | | 0.15 | 0.02 | 0.09 | 0.07 | 0.07 | | |
| BDL108 | 659 | 8123.6 | Av | | 1.25 | 1.56 | 1.57 | 1.21 | 1.36 | | |
| BDL108 | 659 | 8123.5 | P | | | | 0.18 | | 0.19 | | |
| BDL108 | 659 | 8123.5 | Av | | | | 1.62 | | 1.40 | | |
| BDL59 | 698 | 7792.1 | P | | | | 0.11 | | | | |
| BDL59 | 698 | 7792.1 | Av | | | | 1.50 | | | | |
| BDL59 | 698 | 7792.2 | P | 0.17 | | 0.21 | 0.16 | 0.33 | 0.50 | | |
| BDL59 | 698 | 7792.2 | Av | 1.31 | | 1.31 | 1.62 | 1.11 | 1.17 | | |
| BDL59 | 698 | 7792.3 | P | | | | 0.01 | | 0.27 | | |
| BDL59 | 698 | 7792.3 | Av | | | | 1.73 | | 1.18 | | |
| BDL59 | 698 | 7793.3 | P | 0.03 | | 0.01 | 0.03 | 0.02 | 0.04 | | |
| BDL59 | 698 | 7793.3 | Av | 1.89 | | 1.75 | 1.87 | 1.39 | 1.40 | | |
| BDL59 | 698 | 7794.1 | P | | | 0.14 | 0.08 | | 0.29 | | |
| BDL59 | 698 | 7794.1 | Av | | | 1.22 | 1.59 | | 1.18 | | |
| BDL68 | 702 | 7761.3 | P | 0.14 | | | 0.17 | | 0.34 | | |
| BDL68 | 702 | 7761.3 | Av | 1.32 | | | 1.38 | | 1.13 | | |
| BDL68 | 702 | 7761.5 | P | | | 0.30 | 0.02 | 0.46 | 0.02 | | |
| BDL68 | 702 | 7761.5 | Av | | | 1.56 | 1.71 | 1.22 | 1.59 | | |
| BDL68 | 702 | 7761.9 | P | | | | 0.33 | | | | |
| BDL68 | 702 | 7761.9 | Av | | | | 1.30 | | | | |
| BDL68 | 702 | 7764.1 | P | 0.08 | | | 0.15 | | 0.38 | | |
| BDL68 | 702 | 7764.1 | Av | 1.27 | | | 1.77 | | 1.21 | | |

Table 30. Provided are the growth and biomass parameters of transgenic vs. control plants as measured in Tissue Calture assay under 0.75 mM Nitrogen concentration.
"P" = P-value;
"Av" = ratio between the averages of event and control. Note that when the average ratio is higher than "1" the effect of exogenous expression of the gene is an increase of the desired trait;
"Par" = Parameter according to the parameters listed in Table 28 above;
"Ev" = event.

Example 9

Improving Desired Traits of Interest in Transgenic Plants Grown Under Normal Conditions by Reducing Gene Expression Transgenic plants exogenously expressing the BDL127 gene (SEQ ID NO:673) were assayed for a number of commercially desired traits under normal conditions.

To analyze the effect of expression of the BDL127 exogenous polynucleotide in transgenic plants, plants were grown in pots with an adequate amount of nutrients and water. The plants were evaluated using various parameters for their overall size (biomass), structure (plant architecture), relative growth rate, time to inflorescence emergence (bolting) and flowering, seed yield, weight of 1,000 seeds, dry matter, oil content and harvest index [(HI) seed yield/dry matter]. Transgenic plants performance was compared to control plants grown in parallel under the same conditions. Mock-transgenic plants with an empty vector or expressing the uidA reporter gene (GUS-Intron) under the same promoter were used as control.

Parameters were measured as described in Example 3 above.

Statistical analyses—All parameters including plant growth rate, plant area, biomass, plant architecture, time to bolting, time to flowering, weight of 1,000 seeds, seed yield, oil yield, dry matter, and harvest index area data were analyzed using t-test. To identify outperforming genes and constructs, results from mix of transformation events or independent events were analyzed. For gene versus control analysis t-test was applied, using significance threshold of $p<0.1$.

Experimental Results

The polynucleotide sequences of the invention were assayed for a number of commercially desired traits. Table 22 provides the parameters measured in a tissue culture and green house assays (results are presented in Tables 31 and 32). In cases where a certain event appears more than once, the event was tested in several independent experiments.

Analysis of plants in tissue culture assay—Table 31, hereinbelow, depicts analyses of transgenic plants overexpressing the BDL127 polynucleotide of the invention under the regulation of the constitutive 35S (SEQ ID NO:777) promoter.

TABLE 31

| Gene | Ev. | Par. | 1 | 2 | 3 | 4 | 5 | 6 | 7 | 8 | 9 |
|---|---|---|---|---|---|---|---|---|---|---|---|
| BDL127 | 8172.1 | P | 8.5E−03 | 1.5E−03 | 2.0E−03 | 2.4E−04 | 1.4E−03 | 1.6E−01 | 1.3E−03 | 4.7E−03 | 1.2E−01 |
| BDL127 | 8172.1 | Av | 7.4E−01 | 6.1E−01 | 6.3E−01 | 2.8E−01 | 5.1E−01 | 6.5E−01 | 1.7E−01 | 3.6E−01 | 5.3E−01 |
| BDL127 | 8172.4 | P | 4.5E−03 | 1.9E−05 | 3.3E−03 | 7.4E−04 | 2.2E−05 | 2.3E−04 | 2.4E−03 | 9.2E−04 | 4.1E−03 |
| BDL127 | 8172.4 | Av | 7.7E−01 | 6.2E−01 | 7.0E−01 | 4.1E−01 | 3.9E−01 | 5.2E−01 | 2.7E−01 | 2.1E−01 | 3.1E−01 |
| BDL127 | 8172.7 | P | | | 1.8E−01 | 3.8E−04 | 2.0E−03 | 3.4E−02 | 1.8E−03 | 1.7E−02 | 7.9E−02 |

TABLE 31-continued

| Gene | Ev. | Par. | | | | | | | | | |
|---|---|---|---|---|---|---|---|---|---|---|---|
| BDL127 | 8172.7 | Av | | | 8.4E−01 | 3.5E−01 | 6.0E−01 | 6.7E−01 | 2.3E−01 | 5.3E−01 | 6.0E−01 |
| BDL127 | 8172.8 | P | | 4.8E−01 | 3.5E−01 | 3.1E−03 | 2.7E−01 | | 2.2E−01 | | |
| BDL127 | 8172.8 | Av | | 8.9E−01 | 8.5E−01 | 5.4E−01 | 8.0E−01 | | 6.0E−01 | | |
| BDL127 | 8172.9 | P | 3.3E−03 | 1.8E−05 | 3.0E−03 | 3.1E−04 | 2.3E−05 | 4.5E−05 | 1.5E−03 | 6.5E−04 | 1.2E−03 |
| BDL127 | 8172.9 | Av | 7.9E−01 | 5.2E−01 | 5.4E−01 | 3.4E−01 | 3.4E−01 | 3.7E−01 | 2.1E−01 | 1.6E−01 | 1.4E−01 |

| Gene | Ev. | Par. | 10 | 11 | 12 | 13 | 14 | 15 | 16 | 17 |
|---|---|---|---|---|---|---|---|---|---|---|
| BDL127 | 8172.1 | P | 2.6E−02 | 3.8E−01 | | | | | 2.3E−02 | |
| BDL127 | 8172.1 | Av | 7.5E−01 | 8.7E−01 | | | | | 7.6E−01 | |
| BDL127 | 8172.4 | P | 1.6E−02 | | 4.9E−01 | | | | 2.0E−02 | |
| BDL127 | 8172.4 | Av | 7.3E−01 | | 8.1E−01 | | | | 7.6E−01 | |
| BDL127 | 8172.7 | P | 2.9E−01 | 2.8E−01 | | | | | | |
| BDL127 | 8172.7 | Av | 8.9E−01 | 7.5E−01 | | | | | | |
| BDL127 | 8172.8 | P | 5.4E−01 | | | | | | 3.8E−01 | 3.1E−01 |
| BDL127 | 8172.8 | Av | 9.0E−01 | | | | | | 8.3E−01 | 8.7E−01 |
| BDL127 | 8172.9 | P | 1.3E−03 | | 2.0E−01 | 7.4E−01 | | | 6.1E−02 | 4.9E−02 |
| BDL127 | 8172.9 | Av | 5.1E−01 | | 6.9E−01 | 9.0E−01 | | | 7.3E−01 | 6.4E−01 |

Table 31.
"P" = P-value;
"Av" = ratio between the averages of event and control. Note that when the average ratio is less than "1" the effect of exogenous expression of the gene is a decrease of the desired trait;
"Par" = Parameter according to the parameters listed in Table 22 above;
"Ev" = event.

Greenhouse assays—Tables 33-36 represent experiments that were done using greenhouse assays. Table 32 specifies the parameters that were measured in the green house assays and which are presented in Tables 33-36. In cases where a certain event appears more than once, the event was tested in several independent experiments.

TABLE 32

| Parameter symbol used in result Tables 33-36 | Parameter name |
|---|---|
| 1 | Rosette Diameter time point 1 |
| 2 | Rosette Diameter time point 2 |
| 3 | Rosette Diameter time point 3 |
| 4 | Rosette Diameter time point 4 |
| 5 | Rosette Area time point 1 |
| 6 | Rosette Area time point 2 |
| 7 | Rosette Area time point 3 |
| 8 | Rosette Area time point 4 |
| 9 | Plot Coverage time point 1 |
| 10 | Plot Coverage time point 2 |
| 11 | Plot Coverage time point 3 |
| 12 | Plot Coverage time point 4 |
| 13 | Leaf Number time point 1 |
| 14 | Leaf Number time point 2 |
| 15 | Leaf Number time point 3 |
| 16 | Leaf Number time point 4 |
| 17 | Leaf Blade Area time point 1 |
| 18 | Leaf Blade Area time point 2 |
| 19 | Leaf Blade Area time point 3 |
| 20 | Leaf Blade Area time point 4 |
| 21 | Leaf Petiole Area time point 1 |
| 22 | Leaf Petiole Area time point 2 |
| 23 | Leaf Petiole Area time point 3 |
| 24 | Leaf Petiole Area time point 4 |
| 25 | Blade Relative Area time point 1 |
| 26 | Blade Relative Area time point 2 |
| 27 | Blade Relative Area time point 3 |
| 28 | Blade Relative Area time point 4 |
| 29 | Petiole Relative Area time point 1 |
| 30 | Petiole Relative Area time point 2 |
| 31 | Petiole Relative Area time point 3 |
| 32 | Petiole Relative Area time point 4 |
| 33 | RGR of Leaf Blade Area time point 2 |
| 34 | RGR of Leaf Blade Area time point 3 |
| 35 | RGR of Leaf Blade Area time point 4 |
| 36 | RGR of Leaf Number time point 2 |
| 37 | RGR of Leaf Number time point 3 |
| 38 | RGR of Leaf Number time point 4 |
| 39 | RGR of Rosette Area time point 2 |
| 40 | RGR of Rosette Area time point 3 |
| 41 | RGR of Rosette Area time point 4 |
| 42 | RGR of Rosette Diameter time point 2 |
| 43 | RGR of Rosette Diameter time point 3 |
| 44 | RGR of Rosette Diameter time point 4 |
| 45 | RGR of Plot Coverage time point 2 |
| 46 | RGR of Plot Coverage time point 3 |
| 47 | RGR of Plot Coverage time point 4 |
| 48 | Bolting |
| 49 | Flowering |
| 50 | Dry Weight |
| 51 | Seed Yield |
| 52 | Harvest Index |
| 53 | 1000 Seeds Weight |
| 54 | oil content |
| 55 | Fresh Weight |

Table 32.

TABLE 33

| Gene | Ev | Par | 1 | 2 | 3 | 4 | 5 | 6 | 7 | 8 |
|---|---|---|---|---|---|---|---|---|---|---|
| BDL127 | 8172.10 | P | | | | | | | | |
| BDL127 | 8172.10 | Av | | | | | | | | |
| BDL127 | 8172.4 | P | | | 1.2E−03 | 1.7E−03 | 7.1E−03 | 1.7E−03 | 5.9E−03 | 1.6E−03 |
| BDL127 | 8172.4 | Av | | | 7.6E−01 | 7.7E−01 | 7.1E−01 | 2.0E−01 | 6.7E−01 | 6.5E−01 |
| BDL127 | 8172.7 | P | | | | | | | | |
| BDL127 | 8172.7 | Av | | | | | | | | |
| BDL127 | 8172.8 | P | 8.0E−04 | 2.2E−04 | | | 1.8E−02 | 1.2E−02 | 1.7E−02 | 3.3E−02 |
| BDL127 | 8172.8 | Av | 7.4E−01 | 7.0E−01 | | | 6.2E−01 | 5.7E−01 | 5.2E−01 | 5.2E−01 |
| BDL127 | 8172.9 | P | 2.1E−02 | 6.4E−03 | 8.8E−04 | 7.1E−04 | | | 1.1E−02 | 4.4E−04 |
| BDL127 | 8172.9 | Av | 8.0E−01 | 7.1E−01 | 7.3E−01 | 7.3E−01 | | | 6.1E−01 | 5.6E−01 |

| Gene | Ev | Par | 9 | 10 | 11 | 12 | 13 | 14 | 15 | 16 |
|---|---|---|---|---|---|---|---|---|---|---|
| BDL127 | 8172.10 | P | | | | | | | | |
| BDL127 | 8172.10 | Av | | | | | | | | |
| BDL127 | 8172.4 | P | 7.1E−03 | 1.7E−03 | 5.9E−03 | 1.6E−03 | | | | |
| BDL127 | 8172.4 | Av | 7.1E−01 | 2.0E−01 | 6.7E−01 | 6.5E−01 | | | | |
| BDL127 | 8172.7 | P | | | | | | | | |
| BDL127 | 8172.7 | Av | | | | | | | | |
| BDL127 | 8172.8 | P | 1.8E−02 | 1.2E−02 | 1.7E−02 | 3.3E−02 | | 3.6E−04 | | |
| BDL127 | 8172.8 | Av | 6.2E−01 | 5.7E−01 | 5.2E−01 | 5.2E−01 | | 7.8E−01 | | |
| BDL127 | 8172.9 | P | | | 1.1E−02 | 4.4E−04 | | 4.5E−02 | | |
| BDL127 | 8172.9 | Av | | | 6.1E−01 | 5.6E−01 | | 8.5E−01 | | |

Table 33.
"P" = P-value;
"Av" = ratio between the averages of event and control. Note that when the average ratio is less than "1" the effect of exogenous expression of the gene is a decrease of the desired trait;
"Par" = Parameter according to the parameters listed in Table 22 above;
"Ev" = event.

TABLE 34

| Gene | Ev | Par | 17 | 18 | 19 | 20 | 21 | 22 | 23 | 24 | 25 | 26 | 27 | 28 | 29 | 30 | 31 | 32 |
|---|---|---|---|---|---|---|---|---|---|---|---|---|---|---|---|---|---|---|
| BDL127 | 8172.10 | P | | | | | | | | | | | | | | | | |
| BDL127 | 8172.10 | Av | | | | | | | | | | | | | | | | |
| BDL127 | 8172.4 | P | | 5.4E−04 | 2.0E−03 | 7.7E−03 | | | | | | | | | | | | |
| BDL127 | 8172.4 | Av | | 3.3E−01 | 6.9E−01 | 6.3E−01 | | | | | | | | | | | | |
| BDL127 | 8172.7 | P | | | | | | | 1.8E−02 | | | | | | | | 3.1E−02 | |
| BDL127 | 8172.7 | Av | | | | | | | 6.8E−01 | | | | | | | | 8.0E−01 | |
| BDL127 | 8172.8 | P | 3.3E−03 | | 1.4E−03 | 2.1E−02 | | | | | | | | | | | | |
| BDL127 | 8172.8 | Av | 6.9E−01 | | 6.2E−01 | 5.6E−01 | | | | | | | | | | | | |
| BDL127 | 8172.9 | P | | | | 3.8E−04 | | | | | | | | | | | | |
| BDL127 | 8172.9 | Av | | | | 5.7E−01 | | | | | | | | | | | | |

Table 34.
"P" = P-value;
"Av" = ratio between the averages of event and control. Note that when the average ratio is less than "1" the effect of exogenous expression of the gene is a decrease of the desired trait;
"Par" = Parameter according to the parameters listed in Table 22 above;
"Ev" = event.

TABLE 35

| Gene | Ev | Par | 33 | 34 | 35 | 36 | 37 | 38 | 39 | 40 | 41 | 42 | 43 | 44 | 45 | 46 | 47 | 48 |
|---|---|---|---|---|---|---|---|---|---|---|---|---|---|---|---|---|---|---|
| BDL127 | 8172.10 | P | | | | | | | | | | | | | | | | |
| BDL127 | 8172.10 | Av | | | | | | | | | | | | | | | | |
| BDL127 | 8172.4 | P | 3.0E−07 | | | | | | 4.1E−02 | | | | | | 4.1E−02 | | | |
| BDL127 | 8172.4 | Av | −1.1E−02 | | | | | | −5.2E−02 | | | | | | −5.2E−02 | | | |
| BDL127 | 8172.7 | P | | | | | | | | | | | | | | | | |
| BDL127 | 8172.7 | Av | | | | | | | | | | | | | | | | |
| BDL127 | 8172.8 | P | | | | | | | | | | | | | | | | |
| BDL127 | 8172.8 | Av | | | | | | | | | | | | | | | | |
| BDL127 | 8172.9 | P | | | | | | | 3.4E−02 | | | 2.1E−02 | | | 3.4E−02 | | | |
| BDL127 | 8172.9 | Av | | | | | | | 8.0E−01 | | | 7.4E−01 | | | 8.0E−01 | | | |

Table 35.
"P" = P-value;
"Av" = ratio between the averages of event and control. Note that when the average rato is less than "1" the effect of exogenous expression of the gene is a decrease of the desired trait;
"Par" = Parameter according to the parameters listed in Table 22 above;
"Ev" = event.

TABLE 36

| Gene | Ev | Par | 49 | 50 | 51 | 52 | 53 | 54 | 55 |
|---|---|---|---|---|---|---|---|---|---|
| BDL127 | 8172.10 | P | | | | | | | |
| BDL127 | 8172.10 | Av | | | | | | | |
| BDL127 | 8172.4 | P | | | 2.0E−02 | | | | |
| BDL127 | 8172.4 | Av | | | 6.9E−01 | | | | |
| BDL127 | 8172.7 | P | | | 2.0E−02 | | | | |
| BDL127 | 8172.7 | Av | | | 7.3E−01 | | | | |
| BDL127 | 8172.8 | P | | | | | | | |
| BDL127 | 8172.8 | Av | | | | | | | |
| BDL127 | 8172.9 | P | | | | | 3.1E−02 | | |
| BDL127 | 8172.9 | Av | | | | | 8.1E−01 | | |

Table 36.
"P" = P-value;
"Av" = ratio between the averages of event and control. Note that when the average ratio is less than "1" the effect of exogenous expression of the gene is a decrease of the desired trait;
"Par" = Parameter according to the parameters listed in Table 22 above;
"Ev" = event.

These results demonstrate that transformation of plants with the BDL127 gene results in decreased yield, seed yield, biomass and growth rate and thus agents which downregulate the expression level of the BDL127 gene in plants such as co-suppression agents, antisense suppression, RNA interference, remodeling of the promoter structure and/or Ribozyme can increase yield, seed yield, biomass and growth rate of a plant.

The genes identified herein improve plant yield in general, and more specifically oil yield, seed yield, oil content, plant growth rate, plant biomass, root measurements, ABST, NUE and plant vigor. The output of the bioinformatics method described herein is a set of genes highly predicted to improve yield (seed yield, oil yield and content, biomass) and/or other agronomic important yields by modifying their expression. Although each gene is predicted to have its own impact, modifying the mode of expression of more than one gene is expected to provide an additive or synergistic effect on the plant yield, plant growth rate, root measurements, ABST, NUE, plant vigor and/or other agronomic important yields performance. Altering the expression of each gene described here alone or set of genes together increases the overall yield plant growth rate, root measurements, ABST, NUE, plant vigor and/or other agronomic important yields performance.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (1008 sequences)

SEQ ID NO: 1 - DNA, 2377 bp, Oryza sativa
ggggaggaggaacaaacaactcatcgtctcgactcgattctcaccgaggcagcgaaaaaaaaagaggggagagaaaaaaaaacaccagcgaggcaacgagggggtgggtggtggtggcggcggcggcgatggagagcgagatggcggacgcggcgccggcaccggcggtggcggcggcggcgacggcggagccgctggcggcggtggcggaggaaggggaggaaggcggggaggcggcggtggggtccaccctcaccatggagcgcgtcgccgcggcgaagaagttcatcgagaaccactaccgctcgcagatgaagaacatccaggagcgcaaggagaggcgctttagattggagcgacaactggaatcttcccaagttcccagggagcagcaaatcaatctactaaaagatctggagagaaaggaaacagagtacatgcggcttaaaaggcacaaaatctgcgttgatgactttgagctgctcaccattattggcagaggagcttttggagaggttcgactctgccgggagaagacatctagcaacatttatgcaatgaaaaagctaaagaagtctgatatggttgtcaggggtcaagtggaacatgttagagcggaaagaaacttgctggctgaagttgctagccactgcattgtgaagctatactattcttttcaagattcggagtacctttatcttatcatggagtatctccctggtggtgatatcatgacccttctcatgagagaggataccttaactgagcatgtggctcgattctacattgctgagaccatccttgctattgagtccattcataaacacaactacatccacagagatattaagcctgacaacctgcttctcgacaagaatggtcacatgaagctgtcagattttgggctgtgcaagccaattgattgttcaaagctctcaacattgaatgaagatgaaccgatgggtgatgacaatttgagggaatcaatggatatcgatagctctttctctgaaacaacaaatggtagaaggtggagaagtcaacatgaacaacttcagcactggcagatgaacagaagaaaactggcattctcaactgttgggacaccagactatattgctccagaagttctgctaaagaagggatatggaatggaatgtgactggtggtctttgggtgcaatcatgtatgagatgcttgttggttatccaccattttattctgatgatccaataaccacatgccgaaagattgtccactggagaaaccatttgaaatttccagaggattcaaaggtgtctcctgaagcaagggatctcatttgccggttattatgtgatgttgaccacaggattggcagtgcaggagcagaccaaataaaggcacatccttggttccgtggagttgcttgggaaaaactatatgagatggaagctgcatttaagcctcaagtaaatgatgaactggacacacagaacttcatgaagtttgaggaaatggataatgctccaaccagaacaggttccgggccctcaagaaagatgatgctgaattccaaagacctcagctttgtgggatatacgtacaaaaactttgatgctgtgaaaggattgaaacattcagatcaacaaaggaaccaatctctaataaggccctctattggctccatttttggtccagcagatatggatccatctagagaaccaaatggaagggacaagcacatgcacacagtttcttctggtgatccgatgattcaatgacctgcgtcccgttgttccttggaaaatcctgaactaaaattagcatgcgacgcctgaacgatgtggcttcatccggagaacctgcttgttttaggccaggttatctgccctgttaatcgttggcgagcattctgtagaaatccaacaaagcttctagttgtaaaaatagtatgctgagtacttaacaaaacagcccgtgtacccaggggggcttgtggtctttgttgtagcgtgttgggaccaagcggaaatgggcaggttggggggagtatttgcacctttgggggctggctgcccaggttggcagagctaattgccgccttctcttgtggcagttcctggtccgctgacattttcatcttgtggaaacaaacaaataaggcaagctatgctgttgttgctgttgccggtggtgttttgatgtgcgtgtgtatcagcagaaatttaattttccgtaacgacccttttgccccctagtctatggtctcccgttgcagaaatgcctaattttgtctgttagtgtaatgttcatcagttatatctttggtcatgtactattattgaaccctctgacttcataattttgtggagatactaccttcttttccgatgta

SEQ ID NO: 2 - DNA, 753 bp, Brassica napus
cggcacgaggggtctcttctcagatactcattcacagaaagaaaccatgaccgtcgtctctctgttagtcgccttcaccgttgttgcactctgtttacactcttcaacatctgagttcctgaagtttcagctttccaccatatcagctgcacctacgtttttgcctgaagctccttcgagtttctcagcttcacctccggaggctatgtctccagatatatctcctctgttccctactccaggttcaagcgaaacgtctccttctccgtcagaatcttttgacatcccgacaatcccctcgagccttagtccaccaaatccagatgccgtctctcctgatcctctgcttgactcttctcccgtggggtctcctcttcctgcttcttcctctgtttctctggtctcgtcaccactctctctgcttctggccttccccatgttaatgctagctttctgcagattctaataaattattttgaaacagagtaagagagtaagccctctttgacatcttgcttgaagaaaaagattcacaatgtattctttttactctatgcttgtttatgaaactttatttttcttgtataatttaatactactattgttcgtgtgaggaggctctatgccatctggccggtgcagttgttgcacttgtaacggttgatatgagtagtgggccttcccgtgggatgcgtctttataaaatcacctgctacaactttcttcataaatgttcaagtgggacaattgtgt

SEQ ID NO: 3 - DNA, 791 bp, Brassica napus
gctctctgcgacttagggttttagaataaacctcgccgcaccctctctctgtttaatccgtcttacatctgcgacgaacaaaaatccctgatttcgcgttgtttgcattaccttgagaaggctcagtgatgaggaagctcaagaaccatgagaagaaggttctgaagaaagtaaatttcctggaatggaaaagagaaggcggccatcgcgaaaccctgatcacgggtcgttaccacatgggtggtcgtgacgactacaaaaaatattcaggattgtgtaggatggtgcagaagctgacgaacgtgttgaaacagatggatgcgactgatccttttcggattcagatgactgatatgctactcgagaagctatacaacatgggagttataccgacaaggaaaagcttggctttaactgatcggttatcagtttcctccttctgcaggcgtaggttatcgactgtgttggttcacctgaagtacgctgagcacttgacagaagcagtgacgtacatagagcaaggacacatccgtgtaggaccagacacgatcactgatccagccttcttagtaactcggaacatggaagatttcatcacctgggttgattcttccaagatcaaacgcaaggtgcttcaatacaacgacaagttggatgactacgacatgcttgcttaaaatatatctcacttctcaaagtgtgtaaaccttttctattaccaaactatatgtttctcatttagtttcagaaattaggacaagaaaacaaagattcaatcaaaagtactttga

SEQ ID NO: 4 - DNA, 1287 bp, Brassica napus
gatcgtcctgtttcttaaaatttttcggtaacagaggagcgcggctacgaaaccgctctcgaattcctttttcattcggaacatcacccaattctctagcaatttccacatgacttcagatgctctcaacataccatccgagcttgaatctgcgttacggctcaggacggtacaatactttatcacaaagaggccttggcttgatctctatggagtccatgtaaggcccgtggcaccattcggaagcacaagcagtaaaccacaatttgatcctgctttgattcatcgctccttgcctgatgagcttcttttcgaggtgtttgctcggatgttgccttatgaccttggcagagcagcttgtgtctgcagaaagtggaggtacactgttcgcaaccctgtcttctggcgtaacgcctgcttgaaagcttggcagactgctggggttatcgaaaactataggatcttgcagtctaaatacgatggatcatggaggaaaatgtggcttcttagatccagagttcgtactgatggtatttatgtgagtagaaacacttacattcgagctggaattgctgagtggaagattacaaatccagttcacattgtatgttacttccgctacataagattctacccttctggtagatttctttacaagaactcttcgcagaaactgaaggatgttgccaaatacatgaactttaagtcttctaaagcagatggtctttacagaggcacttacacattgtcaatgacagatgacaagatcgaagcagctgttctgtatccagggacgcgccctactgtcttaaggatccgtttaaggttaagaggaacggcgataggagcgaataacaggatggatttgctgtcactagtgacaagtggtgtgaacgatgaggaaggaagtagcacagaagaagacattcttggggtagttgaaaattggagagacgatgaaactcacaacccggatatacctgccgtctcacacaagaggggtatgactcccttcgtcttcgtcccgttcgaagaggttgaacaatcggtcttgaatttacctccagagaaaatggattactttgtcaccggctagagtgacgcatcgcatcaacgcctatctcagtgtacaaagaagatgatatatcaatgtagaatataatgtttgcatgctttatttgattattatgactacaacattactactagtggtgtctgtttgttgctgttacaaggcgcagtgtgacattttgttgtttacatataaacatgcaagaagctttaatc

SEQ ID NO: 5 - DNA, 911 bp, Brassica napus
cggacgcgtgggttttttttccgtttcagtttttcttttttcaagaaagagagaaactctgtgtgtttgtatttatttggatctaattgttaaaaaagatgcaagttgtttctcctttatctccggcgacgagattcgtcggaaaagagagcttcgccgagctttacggcaaactaaacgctgacttcagctcgaaactgaaggtcggttttacaaacgaggaagaagaaaagaacagagatgacaacaagtcttggtggaatcaagatgatgatgatgatgagagagaagaaggagaagaagatgaagagttctcgttcacgagcttaaacgcagataactcaccgataaccgcagacgaagccttcgaagacggtcagatccgaccggtttatccactctttaaccggaatctcctcttcgaaccggaagagagagatctccgctcgcctctcaagaagctcttcgtggagagcgaggaagccgccaccaccgaaagggaggaagaatctgagccgatgggaccgtactgctcgtggtcaggcagaaccgtggtggaggaagcttcgccggagacttgtcggaaaagcagttcgacggggttctcgaagctgtggaggtttaaagatctcgtttcgagaagcaacagcgacggaaaagacgcgtttgtgtttctgaatcacggcgacaagaagaagcagtcttcttctaagccggcggctaaattgagcggcggcgtgaagagaacggagacgaaaacgacgagatcggcacatgagaggttatacatgaggaacagagcgatcagagaagaagggaaacgaagatcgtatcttccttacaaacatgtcggattcttcaccaatgtcaatggacttactagaaatgttcatccttactgatcatcatga

SEQ ID NO: 6 - DNA, 3062 bp, Arabidopsis thaliana
ataatgtggcttggcttatctctcagcacaagtgtttcctcttaaactcatccaatagtcctttacgccttcaaatccttcttcattctcccattcacaattccttcatttttaatttttgattcatcctccattttttttttctgaaaaacaagaaaagttcaaaaaaaaaccaaaaaaccaatctcggttttcgtcattgtattcatctttaatggtagaccgtagacacgtattttgaagggaattacaaaattttaatactatctcttaccaaaaaattagaaaatagagagaagaaaaatgaaagtggcagttataggaagtggtataagtggattaggaagtgcttacgtacttgcgaatcaaggagttaaagaagttgtgttgtacgagaaagaagagtcattaggaggccatgccaagacggtgcgtttcgatggcgttgacttggatcttggtttcatggtctttaatcgtgttacatatccaaacatgatagagttcttcgagaaccttggagtagagatggaggtttcagacatgtctttcgcagtgagccttgacaatggcaaaggttgtgaatggggaagccgcaacggtgtctcgggcttatttgctcaaaagaagaacgttttaaatccgtatttctggcaaatgatcagagaaattgttagatttaaagaagacgtcttaaattacattgagaagcttgagggtaaccccgatatcgatcgaaaggaaaccttaggagaatttctcaatacacgtggatactctgagttgtttcagcaagcttacttagtaccgatatgcggttcgatatggtcatgcccatcagatggtgtcttaagcttctctgcttactctgttctttcgttttgttgcaaccaccaccttcttcagatctttgggaggccacagtggctaactgttgcaggacgttctcagacttacgtcgcaaaggttagggcagaattggagagactaggatgcaagatcagaacaagctgcgacgtaaaatctgtttcgacatccgaaaatggttgtgtaactgttacaagtggagatgggtctgaagaagtattcgataggtgcatattggctatgcacgccccagatgctctgagattgcttggtgaagaagttacatttgacgaatctagggttcttggtgctttccaatacgtttacagcgatatatatctccatcatgacattgatttgatgccacggaacaaagcagcgtggagtgcgtggaatttcttgggaagtacggaaaagaaagtatgtgtaacatactggctcaatatacttcagaaccttggcgagaacagtgaaccattctttgtaacacttaacccagacgagaccccaaagaaagcattgctcaaatggaccactggtcaccctgtaccatcagttgcagcttcgatagcttcacaagagcttcaccagattcaaggcaaacgtaacatatggttctgtggtgcatatcagggctatggtttccatgaagacgggctaaaggccggtatggcggctgcacgaggtttgttagggaaagaaacagctcttctgaacaatccgcgacatatggtcccttccttgacagaaacaggagctcggcttttcgttactagattcttgggacaatttatatcaaccggttctgtaacaatactagaagaaggaggaacaatgttcacattcggagggaaggattctacttgtcctctgaaatctatcctcaagattcacagtcctcaattttactggaaggttatgacacaagcggatttaggacttgcagatgcttatatcaatggagatttttctttcgttgataaagaatcaggacttttaaatctgattatgattctcattgctaacagagatacaaaatcaaatcttactaagaaaaggggatggtggacaccgatgtttttaactgcgggtttagcatctgcaaagtattttctaaagcatgtctctaggcagaacactctaacacaagctcgtagaaacatttctcgtcactatgaccttagcaacgagcttttcggtttgttcttggatgataccatgacttactcctcggcagtattcaagtcggatgatgaggatctgagaactgcacagatgagaaaaatatctcttctgattgataaggcgagaatagagaaggaccatgaggttttagagataggatgtggatggggaactttggccatagaagttgtgagaagaactggatgcaaatacaccggcattacgctatctattgagcagcttaaatatgctgaagaaaaagtgaaagaagctggacttcaggaccggattacttttgagctccgcgattatcgccaactatctgatgctcacaaatatgacagaattatatcttgcgagatgctagaagcggtcggacatgagtttatggagatgtttttcagtcgatgtgaagccgcacttgctgaagacggcctaatggtcttgcagttcatatcgacacccgaagagcgttacaatgagtacagactaagttcagatttcattaaagaatacatattccctggtgcatgcgttccttctttagccaaagtcacttcagccatgtcctcttcttctaggctatgcattgaacatgttgagaacattgggattcattactaccaaacattgagattgtggaggaagaacttcttggagagacagaaacaaatcatggctcttggatttgatgataaattcgtaaggacatgggaatattattttgattattgcgcagctggattcaagactcgtactcttggagactaccagttggtgttctcgcgtccagggaacgtagctgcatttgcggattcataccgaggatttccttctgcttattgtgtctcttgagagcaacaacatttggttgcttatgtttttcgatctatacaatatttgatgacctgaaatactagtattgattactgatttgtttggtgtaccaatttgtgaaagtttgttgaataaaagtgagctttactttggaaaaataaccagttactcgt

SEQ ID NO: 7 - DNA, 2076 bp, Arabidopsis thaliana
tttagggacatcaacaagacaacaacctctattcaaatttagagtccatttttgtatttagcaactatccgcaaaacaaatctattaacaaaagtttaaaactttggttcaaattcaaaacttttgggacgagtggcttcccgaaaatcttggagtattagtatctcaccaatcaaatttcaagactcgacaacaaatctttagaagagtcaacaaatttttacagtaatttttttgactctcttcttcttcttcttcttcttcttcttcttcttcttcttcttcttcttcttcatattttccctatgatttggatctctaaaatcttcaatccccatgttctaatttaaaaaatcacaacactctctttatcatataccctattataaaccaaactttgatcctcgaatatattttattaaaaagataatattcgtgtttctcatgttggagtcataataaagaaacctttgtgttttaatttaatcccctccaagaaacctgaagattctaagaagctgccattaaaactaataaaggaagagagtccaaagaagaagaagaagaagagaaaatgtcacgtcttgacgacataccttcaagcccaggcaaattcaagatggagaaatcttcctacttgcatcgtctcagattccaatcttctctcacaaagtttgcatttttctccttcttcctcctctgtctcatctctctactcttcctccgatctccaccgtccattaacccttcttcaccgtccgatccatctcgccgttcactccgaaccaacacctacggaggaccagcttgggaaaaacgtctcagatcctcagctcgaatccgaacctcaacaaacaacggaatcacagttttagtaaccggagcagctggtttcgtcggaacacacgtctccgccgcattaaaacgccgcggagacggcgtaatcggcctcgacaacttcaacgattactacgatccatctctgaaacgagcaagacgagctttactcgagagaagtgggatcttcatcgtagaaggagacataaacgacgtcgaattactccgtaagctattcaagatcgtctccttcacacacgttatgcatttagcagctcaagctggtgtacggtacgcaatggaaaaccctagctcgtacgttcatagcaacatcgccggattcgtcaatctcctcgagatctgcaaatctgtgaatccacaacctgctatagtctgggcttcgtctagctccgtctacggactcaacaccaaagttccgttctcggagaaagataaaacagatcaaccggcgagtttatacgccgccactaaaaaagccggcgaagagatcgcacatacctacaaccacatctatggattatctctaaccggattaagatttttcaccgtgtatggaccttggggaagaccagacatggcgtatttcttcttcactaaagatattctaaaaggcaaatcgatttcgatattcgaatcggcgaatcacggaacggtggctagggatttcacttacatagacgatatagtgaagggatgtttagcggcgctagatacggcggagaagagtacagggagtggagggaagaagagaggtccggcgcaattgagagtgtttaacctcggaaacacgtcgccggtgccggtttcagatctggtgaggatattggagagacaattgaaagtgaaggcgaagaagaatttgattaagatgccacgaaacggtgacgttccgtttactcatgctaatattagtttagctcaacgtgagcttggttataaaccgactacggatttgcaaaccggtttgaagaagtttgtcagatggtatttgagttattactccggcgacaaaaaagccgccgctagatgatctttttttctggttgatgatgatcttttgatttcttgttttttaattgatttgagtaatttttgggaatttgttgtaacagatttgaacacataacccatttcggtaattttatttaattcatttattttacttctaaatgttgtctgttctagttgatttgatcaaataaaagagattaacgaaag

SEQ ID NO: 8 - DNA, 664 bp, Arabidopsis thaliana
gccaaaaaaaaaacctaaacgcatcttcttcttctcactttcaaggatcaagagatcgcttcttacagttccatcttccaacattttactcagcagcttcagatggtgattccaccagcagtgagaccaccacgtctcttcgactacctaaaaccttacgtgctgaaaatgcatttcacaaacaagtttgtccacgcacaagtcatccactcaccaacagccacagtggcttgctcagcgagctcgcaagagaaagcattgagagaaacaatggacatcacacgcgacgtcgctgctgcttcaaagattggtaaaattcttggagaaagactcttgatgaaagatattcccgctgttactattcagatgaagaaagaacagaggtatcatggtaaagtcaaggctgttatcgattctgtaagagaagctggtgtcaagttgctctgaagattattcaataatctgaatcagtttggcaatgtcgtttctttttccggttaatcggacaaattgagataagattggtgccacatttttaaagccctgcttttaaaatccatgttacaagataatgaatgttataagctttgactatggaagtaaaatagattacataaatttaatgtctttaatactattctgcgattaatggtgttttcttcac

SEQ ID NO: 9 - DNA, 1454 bp, Arabidopsis thaliana
aaaaaaaaaaaatcgtatatctctcagcgcgagggaagaagaagaagatgaagctaaaatgggaatcaatctctaatcttcaacaaaacacatatctcataaaactcgtcgctgcaacacttataacttgtctcgcttttcgtttcttcgtcttccgcttcggccaattttccccagttcaagtgtcggtgaccggaaactccaattcccagatttctccgacgtctgttatcttatcggataacgaagatcaaattcccgtcgatattgaggtggagaagtgtgatctatttactgggaaatggattaaagatcctttgggaccaatctacacgaatgagtcatgtggtatcgttgtagatgctcaccagaattgcatcactaatggtcgacctgattctggttttctcaattggaaatggaagcctaatgactgttccttgcctcggtttgattctctgagatttctgcagcttatgaggaataaatcttgggctataatcggtgactccattgctcgtaaccatgtcgagtctttgctttgtatgctatctacagttgaaaaacctgttgaagtgtatcacgatgagaactatagatcgaagcgttggcattttccttcgtataactttacggtatccaacatttggtcaccttttcttgttcaagctgatatctttgaagactcaaatggtgtctcatcagctgcagttcagcttcatctagataaactcgacaatacatggactgatctattcccgagccttgactatgcgatcatctcttcaggggaatggttcttgaaaactgcggtataccacgagaatgctaatcccgttggatgccatggctgcccggagagttcgaacatgacggatttaggattcgactatgcttacaatacgtcgttgcgccatgttatggacttcatagcgaaatctaaaactaaaggcatgatctttttccggacttcgatacctgatcattttgaagatggggaatggcataacggtgggacttgtaagaaaacagaaccggtgggtgaagaggcagtcgagatgaaagttctgaacaagatattgagagatgttgagattaatcaattcgagagagtggttacggagatgggtcaggagagtgagaatctaaagcttctggattttgctggcatgttgctgactcgacccgatggtcatccgggtccatatagagagtttaggccgtttgataaagataagaacgctacggtacagaacgattgtctgcattggtgcttgcctggtccgattgatcacttgaacgatgtcatattggagatcatagtgaatggtcgaaccggtaaataaccagtttgcttgtatgtagtcaatggcttaaaaactggatgaattgaaaacagaggtttggtatataggtcatgtaaattttggtaaacatgaagagatttggttaac

SEQ ID NO: 10 - DNA, 1145 bp, Arabidopsis thaliana
gagaaaactttatagtttatagagtgtagattagataaagctctgaccttggaacgattttgccggagcttgcaatggcgcaactaatacgaccaataaggcaattgtcgccgcaatgtaatcaccattttcgtaatctccggtatttgttttcgaaaaagctaccgaacccaccttcttctatccccactcttcttctcttctcgtctttctccactgaaaggtctccacctcgtcggcgaattcgtcccgcgccaccggaagctttaaagcctactgttattgttgccgaagaagatggtgataacgatggttacgagtctgattcgttgaggagtcgtaaccagcggaagcgtgatgctcgccgtgccgttaaatggggtatggaacttgcttccttctccggtgatcaggttaagcagattctgaaagctgcgtcgcttggtgaagaggtttatgatgcattgatgcttgcgaagagactaggctcggatgttcgagaaggaaagcgtagacatttcaactatattgggaaattgttgcgtgaagttgaacctgatttgatggacactctgattaatgctacaaagcagggtgatcactcaacgctgcagacgctgattagttcagcaaaggatgtcgcagatgatgttggagacagttatgatgatgatacagaaacagagtcagaagatgaagaggaggggtctgacgaatatacggctatggctgcgagatggtttgatggcctaatcagtcaaaatgtggaacttacaaaggaggtttattctcttcagagtgttgatttcgatagacaggaattgcgtaaacttgttcggaaagtacagttggttcatgagcaaagaaaaggcacaacagaggagaagcagaaagaagttgaggctgcattagtgactgctgaaaagtctctgaatcaattcctctgctccatggcgaaacaagtgcacagtgagcagactgatttgtacttatgaatgataatgtgttcttgactctctatttgttttttatatatatcagaactccattctttccccagacatccaaaggaccatagttttttaggtgaatgttgttaatcgaatgatcctgtacaataagtccataaggcataagcttggcaa

SEQ ID NO: 11 - DNA, 597 bp, Arabidopsis thaliana
gtttgttttaaacaaaatgaattttttctcagctttctcttttgtttggtttctccgtcgacgataccaaaggcgattcagcttgatttgtttgatccaacgttttgatcatgaaatcgggagagcaaccacatatactcaatatacaaccgccggaatgatgatcgacgatgagattgttcaccaagtcaacttcaaaccggatcttgtggttatattgttcaattctttgtaacaccaggagcttctatcatgtggctatctcatgagctcttaccaagaggactgggaagaatagaaatggtgccaacatcaattgtggaagagaccaaatgctttaaatgtatgtattgttgtgagttttatcgattaatgagtttggtctgaacttaaccatatccattaatgactgaatgtgtgtgtttggtctgaacttaaccaaattgattaatagatgaatgtgtgtgtttggtctgaactcaaccatatcgactaatagatgaatgtgagtgtttggtctgaacttaaccattttggttacaatcgagtaatgagttttatttcatgagtttcatctattagcttatgtacttgacc

SEQ ID NO: 12 - DNA, 1092 bp, Arabidopsis thaliana
aatggtgcttctacttgtgattgtgggattaataagctattatgtctacaagtccataacaccgccgccaccgattccactgccggaaaatgtttccgagatatctccaagaatcaagctcaatgatggaaggcatttagcgtacaaggaattagggtttccaaaggacaaagccaaaaacaaaataataatcgtccacggaaatggaaattccaaagacgtcgatttatacatcacacaggaaatgattgatgaattcaagatatactttttgttcttcgatagagctggttatggagaaagcgatcctaatccaacacgaacgctgaaaacagatacatacgatatcgaagaacttgctgacaaattgcaagtcggtccaaagttccacgttataggcatgtcacttggagcttaccctgtttacggttgcctcaaatacattcctaataggctcagtggagcttcgttggttgttccgttagtgaatttttggtggagccgtgtgcctcaaaacttattgaatgcagcgatgaagaaattgccaattggatttcaattgacacttcgagtcgcacactactctccatggttgttatattggtggatgactcagaaatggttcccgaatagtcgaaatcccaaagatactatgaccgagcgcgacctagaactcgcggaaaagcataccaaacactcttatatcaaggagtctgctttacgacaaggtggatatgtgaccacacaacaagacatcatagcgggttacgggaattgggaatttgatccaaccgaattgaagaatccgttttcggatagtaacaaagggtcggttcatatgtggtgtgcactcgaagacaaacaaatttcacgcgatgttttactctatatatgcgataaactgccatggataaagctccatgaggtccctgatggtggacattatattatccatgagaagcggcattttgaagccattatcaaagccgcttgtagtgactagtggaagatacattataacaaaaaaaaactctaaaagatttgtatctaaaatcagtttaagaaaaattatggctatgtaagtttcatgtg

SEQ ID NO: 13 - DNA, 1914 bp, Arabidopsis thaliana
gttagattatcgaaattttggattcgaacgtgtggatcgctggaaaaattaaactttagggtcgctagattacgattgcttcgctttttagtagtagtaggctacaatcgattggcaaacatctctatatcggccataactccgtcaagctctgcagaggctgcttcatcagtattgagagacttcctggtgattgattctcatgtctatgtctgagtttggcattgtctacgccatccatatcatcaccgtccaattcggctccgtcgtctcgaaagtttgtgaatgtcttctacgtaaaggacctctttcctcacgagacatctctcgtttagctgaatcagatatcaaccataacaaagttaaagatattctctatctcttgattcagcacaattgtgttcaagctttctccattgaacctcctgatggttctgagagcaaagctattgtacagtatattgtgttgtttaacaacattctgcatcgtgtgaggtataacaagttttcgaggattgtaaacgaagaacttgactccaagtgcggtgcagttcttgatggtttacttagtaacggtaggcttaccttgggacagtttattgaaagagatagagattcaggaaatacgataggttctgaagcaatcagagattctcttcagaaattggttgctgcccgttttgttgagcgcattccttctcccgaacctgttcttggaaacaaagaaaaagagccggcaaagagaagaggcgctaaagctgccaagattcttaaagaaccagaaaccttggaggaacaagttgttgaagcagcaactccagttgacgcaataaggtttccacttatattcgaagaagattccaattcatctttagcagatgacaatagcaacatcactgaggggaagcgtaaacaacgtgatgtggacacatcagattcgagcagtggagtaatttggcgtcctaattttgaggagttcatccaccgccttagacataaggcgtgtgtggagatagtgaaagagcgccgggatgaaggatgtgccattgtcttgagggcaatgttagaagtaggaagatcgcaagagaagaaggtgaaaacagacaattcggctccaatgtcagttggttccatttatgaagaagttattaagacagaagcaggtcgcactatgttacaagagcgagttgaagcatgccttgaccaattgagtgctacgtcttcttatctaccagcatttgtgaacgaagtgaatgattcatacatagttgattataaatccattatcagcgtagcacagaaagatgagatagaggcagtagtgatgagaagatatgggaaagaagctttcagaatgttcagatacttatcacaggaagggcgttttgttgagaccgataagattgctgatgccgcgctgactgaaaagaaagatacaccgcaattccttttaaagatgtggaaagacggatacttacatatgcagaaattggcggtcacagctccgggtatgtatacaccgtttctgttgtggaaggtaaacaagttgattgtgacaactcaaatgttggatgagatgtaccatgcgtcccttaacttgagtcttaggttggcccatgagttagaagccgaaaaagagttgctgttgttgccattagataaactggaaggaccattaaaggagagactgaaaaaggtcaaagccaagaggctgttactctcttccactatgtttaaacttgatgatgccattatgctttttcatgacttttaaactcatacattcaaaaactaatttcttttggtcgatttagttcacattgtcttctagcatttttttttttttttttgacataatgagaagttgtaactttgaaggtaattgatactgtttcgagagaaatgttgtttatt

SEQ ID NO: 14 - DNA, 1696 bp, Arabidopsis thaliana
gttttcttcgccatggcggcgattcctctcaaagctccttctcttcctggaacgagagagtgttctcccttccttaaccggttcgtcactcatcaaccggttaatttcatccggaagtttcatccttccttagatgaagcatcgttctccagacggggacgaaccactgttgttcgcgttttggagacggagaagagtacgaaaatagagaagcctgagcctccggtgaaattgattgctctcgtcggaaaaggagaagtaagcccactcaaatccacctcttgggaagaagttatgctccacactgcgagaagattgaaatgggttgatgaaggatatgaaatgctcgtctttgatgatgaaattgtgagttcaaatgatcagagagctatgaatctgacacaggaactgaatcagactgatatcttggttgtcgttgctgttaataactcagaatctgtgaattggattcagactaacagcaaaaacgtcaagaacatgatttgctttgagtcttctccaaatttgatgaacaggcttggagggactgatgttggaagtgtgaataaagataaagaagtaacagaggttgtgaagacagtgggagatgcttgggaacgtcgtaactctgatgatataaggttttgtttgctcgtgatcatcaacgcttatataagaccagttcctgtgttgcaaaacttgaggtccaaaggtttttcgacgcttagttgcatggttaaaaactgtggacctcagattttgaactgtcttttggatccgaattgtcgaaaagctcttcagtgtttgaaccaatgtagtcctgtggatcaggtgtgtagctacaggtgcattgcttcttatgagggtccttactttgaagcgttctctctttgtgtactacagaagcacaattgtttagaactggatgcaaagatccctgagaagccttatgtgcctcccatgacgagttttcgagggaaggagttgtgtcatgatacagcggaagacttgtttgttgggtggttaggggaattggaatggagctggcgtgtcgtggctggacaaaacccggcttatgatcagtttccatgtcagtaccagctattctacagagggaaagggaagtcgtcgttttggtatgagcccgtgtttcaggtcaggacgctcgaagagaagttggtgtggagaaggagaagatactcggttaagcgaggaaagatccctgcaacgtttcgtttcagtgttttggacaatggtgtggtgtcaaatgagttttggactattgtggatgtatctgatgatctaagttggggactgttccattaccatggagcagcacgtgtagcaggacagtcttacaccggagctgtgcttgtgacaccggatggttcttacccggcagagaaggacaaggagagattgcagtcagcattggagaaatgtgggattaaggaatgggaactctttgctgttgataattgttcttgtgaaaacccgccgctagggattccacagggttctagacttcattcgagaatcagtatcatagaggaaccagactcggaagaaaaattcaactaattttgcactgtggtagtcactgtttttctgtaaattcatgtttgtttaagaatatcattgaatccaatattgagttaaaccctgaggaggcgaaagataggaagaaattcgcgtt

SEQ ID NO: 15 - DNA, 1743 bp, Arabidopsis thaliana
ctgaatcttacgtcctctggatctttcttctctctctctctctcttgtctatactttaagtgtctgtctgaagaagcttgaatctgtcgtgatcatcaagattcaagttctgtctttttgagtctttttcttctacttctattgagtttctcttccttaattgtcggaatcagaatcttttcagatggaggagagagaaggaactaacatcaacaacatcccaaccagttttggtctgaaacaacatgaaactcctcttcctcctcctggttacccaccacggtctgaaaaccctaatctttttccggtgggtcaatccagcacttcctccgccgccgccgcggtgaaaccttctgagaatgttgctcctccttttagcttaacaatgccggtggagaattcttcttctgagttgaagaagaagagagggagaccaagaaagtataaccctgacggctcactcgctgtgactctctctcctatgcctatctcatcctccgttccgttgacgtcggagtttggttctcggaaacgaggaagaggtcgaggaagaggcagaggaagaggacgaggacgtggacaaggacaaggaagcagagagcccaataacaacaacaacgacaacaattggctcaagaatcctcagatgttcgaatttaacaacaacactcctacttctggtggaggaggacctgctgaaattgtcagtccaagttttacacctcatgtgctcacagtaaatgccggtgaggatgtgacaatgaagataatgacattctctcaacaaggctcgcgtgctatttgtattctttcagcgaacggtcccatatccaatgttacacttcgtcaatctatgacatctggtggtactctcacttatgagggtcattttgagattctttctttgacgggttcgtttataccaagcgagagtggaggaacccgaagcagagctggtgggatgagtgtctctcttgcaggacaagatggtcgtgtctttggtggtggacttgctggtctctttattgccgctggtcctgttcaggtaatggtagggagttttatagcgggtcaggaggaatcgcagcagcagcagcagcagataaagaagcaaagaagggaaagactcgggatcccgacaacaacacaagcttctaatatctcattcggtggctcagcggaagatcctaaggctagatacgggctcaacaagcctgttgttattcagccaccaccggtgtctgcaccacctgtgtccttttcgcatgaaccaagtactaacaccgtccatggttactatgcaaataacacagctaaccatatcaaggatctcttctcttccctccctggagaagatagggaagaagatgaggatgatttagaaggtgaagatgatgaagaattcggaggccatagcgaatctgacaccgaggttccaagctgatgatcgatggaaagaatccgacatatatgtgttatgaatcttgagttgttttatttcggtgtcttcagatttttttagagcgtaatggtattttttttctttcagattgttagttgttaaagtcttaaacagagatatttcactaaaagttagggtttactagaggatgtaatctttagggttctttgacttgtgtctttcttttaatcctcagatggttgttgtaggcttgtagccaatcttagtgtgtgttcaaactctctccttcaatcaaactccccaatgacttcattttgaaa

SEQ ID NO: 16 - DNA, 2138 bp, Arabidopsis thaliana
gtcgcagaaaacagagattcctcgctgtctgaactgaaaaataagatcgcattaactcaaaactctcacaaagacaaagatcttctcctccttctcttctctttttcacttttctctcttcccctctctcgaagcttgaaaggtaacaacaatggagaaccctccggatcaaacagagtcaaaggagactcttcaacaacccattacaagaagaagaacaaagggtggtcttctcactatgcccttcatcattgcaaacgaggggttcgagaaagtggcgagctatggattattacagaacatgattctttatctgatgagtgattacagattgggacttgttaaaggacaaactgtcttgttcatgtgggttgctgctactaatttcatgcctctcgttggagcttttctctcagattcatatttgggtcgctttctcaccattgtcattgcttctctctccagtctcctggggatggtggttctatggctaacggcgatgttgccgcaagtaaaaccatcaccgtgtgtagcaacagccggaaccaactgcagttccgcgacatcttctcaattggctctcttgtataccgcattcgcattaatatcgattggatcaggaggaatcaggccatgttctttagcctttggtgctgatcaattggacaacaaagagaatcctaagaacgagagagttcttgagagtttctttggttggtactacgcttcttcatcagttgctgtcttgatcgctttcaccgtcattgtttacattcaagatcatctaggatggaaaatcgggtttggaatacccgcgattctcatgctgctcgcgggtttcttgtttgttttcgcgtctcctctctacgttaagcgcgatgtgagcaagagtctgttcactggtttagctcaagtggttgctgcagcttacgtgaagagaaacttaactttgccggatcatcatgactccagagattgttattaccgtttgaaagattctgaactcaaagctccaagtgacaaattgaggtttttaaacaaagcttgtgccataagtaaccgcgatgaagaccttggttctgatggtttggccttaaaccagtggaggctatgcacaacggaccaagttgagaaactcaaggcgttggtcaaggtgataccggtatggtccacggggataatgatgtcgataaacgttagccagaactcttttcagttgcttcaagctaaatcaatggacagacgtttaagcagcaattcgaccttccaaatcccagctggatcgtttggtatgttcacaatcatagccttaatctcatgggttgttctgtacgaccgcgcaattctccctttagcttcaaagatccgaggcagaccagttagagtcaatgtcaagattcgaatgggattagggctattcatatcattcttagcaatggcggtttccgcaactgttgaacattacagaaggaaaaccgcgataagccaaggactcgcaaacgatgccaactcaacagtgagcatctcagcaatgtggcttgtaccacagtatgtactacacggtttagcagaggccttgaccgggataggacagaccgagtttttctataccgagtttcctaaaagcatgtcgagtatcgcagcttcgttgttcggtctaggaatggcagtggctaatatcttggctagtgtgatcctaaatgcggtaaagaatagctcaaagcagggcaatgtgagctggattgaagataacatcaacaagggtcactatgactattactattgggttttagcgatcttgagcttcgttaatgtcatctactacgttgtgtgtagctggtcctatggtcctacggtggatcaggtgaggaatgataaggttaatggtatgagaaaagaagaagaggaagttattaaattaaactaagaccaattggttgatcataattaaatggtgtacgtgtgttataaaattctatatatttgtatgtaattagattattatatcatggatttggattttcttaggatgtagaggttgatgttaattaatgggtcgtgtgtttatttaattattacaaaaaaaaaaaaaacattgtgtgtatgatatttgattgaagagaatcaaattttcaaaa

SEQ ID NO: 17 - DNA, 1412 bp, Arabidopsis thaliana
acaggcatatatgcttcctttaaccagtccatgaaatttcactacttttataactctctctccctccttcttcttcttccataaaactcttcactaaacctaaagatctcttaagcttaattttgcaagatcatggaccaaagcaattctcttcttagctggacttacttctctcatggaaagacaacggaagagctaagacagactctcgtgtacacaacaatggagttagaacaaacaaagcttgtggctcacgaggagctaaggaagagagatgaacaactgatccacctagaagatgttttaaccaaaaccctcaaagaaagagacgaagctctagagaaatataatcatctcctcttaaataatctcttacttcaacagaagcagcaacagaatcagaatcagaaacaagaacttgtcactcctcctttatcaggagcttcaagtattattgaagacgagcaagttcagccacagcagccgcagcttaactcaaacaagagcttttcgtcttcagacactgaagaaagcatcatgtcaccatcagtgattgatccagtgacgatgaaccaacagattgaagtctcaggagatgagatgttggctacattgttgcctgacaaaccactgcctgaaaagggaaaactcttacaagctgttatcaaggcaggtcctttgcttcagacacttctcttagctggtcctctgcctcaatggcgccacccaccgcctccacttgagacctctgagatccctcctgtcaccattccactacctcagtttcagaacaatggctgtgggaactccaacaagaaaagggcattctcaatctcagatgaaacttattcagagactaagtatcagaaagttcttctccattaaccggctactgatctttttatccttactcaacaaaatactaatatatagtctttctaatataccaatatacagatcacttttcagtattaatctcacttagggtactagtgagagtgatctttttagtcagtttgttgtagatagagcttgatttgaatttgtggagagtgaatctgatccatttagggtttagatctagagagtgatgggaatgaaactcccctggtttaactcatactcgaacatgagtgttttttttaccaagtgagagagttttgctatttgcttttcttttgttgtgcttattgatttcttgttttgtttcctaaacccaattttacattcatgttttggctccatgaatgtaaacttattggggtgttttgtgttttttttcttcctttgtaatccaatttcaccttggtgtaaaatactaaaaatctaaaggaaatgtgatgtttctgttttcaggaaatgtaatgtatagtatgtaaagactttgattatatatatataatatatatact

SEQ ID NO: 18 - DNA, 1886 bp, Arabidopsis thaliana
gggaagtgacagtgaattagggttttactcaaaaaaccttctcgttgtcgttgtttactgctccgacgagaaaatggcgatgcgacatttgagccgatcgagagacgttacaaagagatcgacaaagaagtacatcgaagaacctctgtacaatcgcctcttcaaagatggtggtacagaggtcaaagttcgacagcagcttaatcagttcctcaaaggcactaaacacgtcttcaaatgggaggtcggcgatacgatcaagaaactccgaaatcgcggcctctattacccagctctcaagctatctgaagttatggaagagagaggtatgaacaagacagtgagtgatcaagcaatccatcttgatcttgttgctaaagctcgtgaaattactgctggggagaattattttgttgatcttccggaaacatctaagacggaactcacgtatgggtctcttttgaactgttactgcaaggagttgttgacagagaaagcggaaggtttgctgaataagatgaaagagctcaacattactcctagttccatgtcttataacagcctcatgactctttacaccaagacaggtgagactgagaaagttccggcgatgattcaagaattgaaggcggagaatgtgatgccggattcgtacacttataatgtctggatgagggctttggctgctactaatgatatttctggtgttgagagagtcattgaagagatgaatagagatggtagagttgctccggattggactacgtatagcaatatggcatcgatatatgttgatgctggactgtctcagaaagctgagaaggctcttcaggaactggagatgaaaaacacgcaacgggattttacggcatatcagtttcttattactttgtatggacgtctggggaagctgactgaagtttacagaatttggcgttcgttgaggctggctattccgaaaacctcaaatgtagcttatctaaacatgatacaagtgctggtcaagttgaatgatttacctggtgcagagacattgttcaaggaatggcaagctaactgttctacttatgacatcaggattgtgaatgtgttgattggagcttatgctcaagagggtctaatccagaaagcaaatgagctcaaggagaaagctcccagaagaggtggaaagctcaatgctaaaacatgggagatcttcatggattactatgtaaagagcggtgatatggctcgagcactcgaatgcatgtcaaaggcagtctccatcggcaaaggagatggtggcaagtggctaccgtcacctgaaacagtcagagctttgatgagctatttcgagcaaaagaaagatgttaatggagctgagaatttgttggagattttaaagaatggaacagacaacataggcgcagaaatatttgaaccattgataagaacatatgcagcagcgggaaagagtcaccctgctatgcgacggcgcctgaagatggaaaacgtggaggttaatgaagcgacaaagaagctactcgatgaagtatctcaggatgtgtgaggtctgttccatctctttctccttcattattcacttcagacaaagacatcattagtcgtgatagggtcacttgcattctcacagctctgtctcttattggtaataaaaaaataggctctgaatcggcaaaatcaattgtatgggtctgttttactttcaccgtagactgtttgttcatgtttttgtgaattgtttttggtttagcttggatttacagttgagacagctctcacaatgtaatccctttttttggagatcttattttggttcaagacagaaacagtgtcaagaatacgatataatgctcatcattgttaatgaggaacaaatgtttgcg

SEQ ID NO: 19 - DNA, 1249 bp, Arabidopsis thaliana
catttctctagctttacatagtcaccattttttttgtttgtttgacctcaaaaactcctacgtttctaagctcttctctttgcttcgattcccaaaacgactatttccaaaagggtttaaagaagttatgaacactaatccagtgactaatgggtttgttaaacctgttcctactgaagaagaacaagcaaagattgaggaagtgaggaagctattaggtccattaccggagaagctttcgagtttttgttccgatgatgcagttttaaggtatctaagggcaaggaattggcatgtcaagaaagctactaagatgcttaaagaaactttgaaatggagagttcaatacaaacctgaggagatttgttgggaggaagtagctggtgaagcagagacagggaagatatatagatcgagttgtgtcgataaacttggacgacctgttctcattatgagaccgagtgttgagaattctaaatcggtgaaaggccagattagataccttgtgtattgtatggagaatgcagtacaaaatttgccaccaggggaagaacagatggtgtggatgatagattttcacggttatagtttggcgaatgtatcgttacgaacaacgaaagaaaccgctcatgtattacaagaacattaccctgagagattagcttttgctgttctctacaatcctcctaagttctttgaacctttctggaaggtggcgcggcccttcttagagccgaagacacggaacaaagtgaagtttgtttactcggatgatccaaacactaaggtgataatggaggagaactttgatatggagaaaatggagttagcgtttggtggtaacgatgactcgggttttaacatagagaaacattcagagagaatgaaagaggacgacaagaaaagattggcttcgttggagggcattgtttccgcttctctagactcgctcagcattttatcggtctctgatggtaccgcctctaacagtgctcaccctagctctcatgatgtctctgaggatgagcattaaccacagagaaaggactcatcaaatgtttgtaacttcaagcacacttggaataaatctaattccacttcatgaggttgtagctgcaaccattgtatgttttcgaaacctattctccaccgcgatgagattcaatatgtatttttttcgcgatgagattcaatatgtatttttttcgattagtaataaaaccgtcacagataaaatgcamawaamama

SEQ ID NO: 20 - DNA, 1383 bp, Arabidopsis thaliana
aatcaattcattactttttataccacacggcacacgcgttatcaaagcatattgtgttgcttcgtttaagaaacgaaattagggtctcaatcttatttctcttaattattattattaatccaaacattctcagaactagtttgaatcttttattaaaggatcttgagaccccttcacatgggagagagaaagaaagagagatagcgagagatgttactccatgagaataccaaacccacttcgctctaataattcaaaagatttcactttctcaaacaaaaaaacttctctctttcttttctaatttctaaaaccctaattgaagttccaacaagatcgatcaaggagaagatggatctcgaggattgggaattagtactccccaagaacagcttcaaggatcttgatcttgatcatgacgaggatcatcatggagccatggtgatggactacttcctctgcccatctactaaagatcctctccccaagacagagtctcctccaagatccaaagtggtccctaaaaagattcttcaagttcccatagcttgggaagccgtgttggatcaagacaacacgaagatacccaataaccctgatcttgaaccggatccgcatccggatccggattcaaaaccgaccctttcgacggactctgtttcgtcaccaagagtttccttcaagatcatgaaggacactgaatttgccgacatgaaaattgacccaccagcgaggatcacgagtcctctgcctcagatcgatgatgctgcttcgaaaccctctgatttagaaggaggggatgacttgcgagacaagaaagaagttgttttggaggaagaagatgaagatggtagtggtggtgagagattgaatctgtggaaggctggtctcaatgggattggagcaatctgttcttttggggttgcagctgctgctgctaccgtatgtgtcttcttcctcggacacaacaatatcaaaatctgtaagaacaagaaccagatgcttcggttccagatttactccgatgataataagaggatgaaagaagttgtgaatcatgcaacaaagctcaatgaagcaatctttggtatgaaaggtgttcctgtcgtaagagctcaaatatcttttgggggtcactacgatggactttgaatctcagccatcataatagttcataatgtacatacatgaatgtagtataaggttttgtaaatttctattattttgttcaaatattgattaattatgtggtgttaatagatctttgtgaaatttcatgtaattttttattattattattgtcagtaagaagttaagaacgcataaatcattttataattttctcaaggcatgtatgtcacataaagccatacttttatttta

SEQ ID NO: 21 - DNA, 1098 bp, Arabidopsis thaliana
tgatcgcatccaaaacgtttttccttcccacaggaaaagaagaaaaacagacagcggaggactaaaacaactagccacaacacaacgcttcaaatatatattactctgccactttcttcaatcttccttcaaagattcttattacagcgacacacaactcttttccatttagatttttgattttttttggttctctaaaggaggagagaaatgttggctatcttccacgaggcgtttgctcatccgccggaggaactcaacagtccggcatctgagaaatgctctaaacaaccaaaacttccagaagaaaccctaaatgatttcttattacgttaccctctcaacactttctccatgtctttcggacaagctgctgttcttgcttacgttcgtccctctgcttccttctccatccaccagaggttgttttgtggatttgatgacatctactgtctcttctttgggagcttgaacaatctgtgtcagctaaacaaacagtatggtctcaccaagacaacaaacgaggccatgtttgtgatcgaagcttataggactcttagagacagaggtccttatccagctgatcaggtcgtcaaagacttagacggtagcttttcctttgtggtttatgatagcaaagccggctctgtcttcactgctctgggatctgatggaggggtgaagctatactggggcatagctgctgatggatctgttgttatatcagatgatttggatgttatcaaagagggttgtgctaaatcttttgctccatttcctacagggtgtatgttccatagtgaaggagggttaatgagctttgagcatccaatgaacaagatcaaggcgatgccgagggtagacagtgaaggagttctatgcggtgccaacttcaaggtggatgtgtacaatcgtgttaacagtatccctcgtcgaggaagtgaagccaattggtctctctgaatacttttaataacactttcaatttggtttctttttcgcacttgtgcttcttctccgctttcatcttagttatggactgttcctaagcttgccatgaataaaactgtgaataataaagcttttaatgttctgttt

SEQ ID NO: 22 - DNA, 1698 bp, Arabidopsis thaliana
gttgaatctttagcaacttttctacatattgcccaatttttctgacttgtgtctttttaaatatctcttccgtgtcaaaaatagtttgtgtgttcttgattatacgtaaattcatctgggcatctcttaattttttctaatcgttaaccttaattacaacctcacgatctgtcttaatcgtgtcttaatcgtgtttttactttatcctctttttattgcaacattagagagttttgtgtgttgcagctttatcggtgtgtaagaaaaagacttataagcaagcagttgaagtggtggttgaggtttcggtttcatttccacgagatctctttggctttcttgttgagatctttccacaagaaagtttagttgttttcttcttcctgtgatttcttcgcctaattttttctggatttaaaaacacgagaagtcaaggtgaaatattatcgaagtctctgaatctgtttttgaatggaaccatcatctggaaccggtcctgagaagagaccaaccgttgacttggtcaaggatagaaatggaacggatcagattcttcttcagaatcctagaggcgcctctgtaaagattagtttacatggaggacaagttctttcatggaagactgacaagggtgatgaattgttattcaacagcaccaaggccaacttgaagcctccccatccggtacgaggaggaatccctatatgctttcctcagtttggaactcggggatcacttgagcaacacgggtttgcaagaaacaagatgtggcttgtagaaaacaatccacctgctttaccttcatttgactcaactggaaaagcctatgttgatttggtgcttaagtcatctgatgaagatacgatgaggatctggccttacagctttgagtttcatctgagagtctcattggcattagatgggaacctaacactgatatcacgagtcagaaacatcaattcaaagccttttagcttttccattgcttaccacacttacttctccatttccgatattagtgaagttagacttgaagggctggaaactcttgactatcttgataatatgcatgatagagagcggttcacagagcaaggcgatgcattaacctttgaatcagagatcgatagagtgtacctaaattctaaagacgtggttgccattttcgaccatgagagaaaacgcacattcctcatcaagaaagaaggtctacctgatgtcgtggtatggaatccatgggagaagaaagcgagagcattgacggatttgggagatgatgagtatagacacatgttgtgtgtggatggagcagccattgagaaacccatcaccttgaaaccgggtgaagaatggaccgggaaattacatctctcgcttgttctttccacctaaaacccggtaccggttatcacaaactctgtgtctttcattatcttgtcttgtgggctattttttttgttttagtctatagaacatcacagtgtgtgtgattcgtcggtatcaaaaatccgaaatattaaaaggaaacctgagatttgaaaaggtcacccatttttaggaagtgactagatctcctggttttgtgcgagatttaacttgtgtatgaagacaatgttatatactatattgaagtttgtacttatttgatgaaatcttcaataatactagattttaacccgcggtatatcgcggggacaa

SEQ ID NO: 23 - DNA, 2232 bp, Arabidopsis thaliana
caattttagctgtcaaattttgagttcttttccttatctttgcacttattagtatacatttcgttttgtctagtcaagaaaaatctaagactttttaatcctcccttgtcttctggaaatctgggaggattttaaggttcttcttgtccaaaaattaaaaaaattgccaattgtggattgtgtatcattcattgtcatcatctaatcttcttcttcttctacttacgagtttggagaagttatccgccattgaagcatttaaaatgccggagaaaggaatgattttcccgccggtaccgagccaattggtgattttacggccaagccctcttcttcaatggcggcttggtgctcttacagcactcgtctgcttccttatgttagtcgtttggagtattgacggttgttcgattcaaagcttcgttcagccatggagattcaatgcttactctgttcgaatcagtccttctccgtcgccgtttatgtcaacgaaacccaatctagtatcagagaaacctcaccgccaaaatctcaccttgatgatggctccacgaaatctggttccgaagaagacgaatctcacttcaaactcgacccgggtccagttcgagtggataaccgctggatctcagaagaatttcacggcgaatttgatgagaggttggttggctccgggaggagcgccgtgtagagaagcgaagaccgtcgagatttcagttcccggtgtcgacgggattgattctgtggagttaaccgccggagagattcatgaattcaaatttcaagccatagacgaatctggaaaaaacgtttgcattggtggggactatttcgagactgatatatccggcgagaactggaaatcgagaccaccggtgaaagatttcggcaacggaacttactctttctctttacaggttcatcctgagttcgccggagatttcaatctcaccgtcattttactcttccgtcattaccaaggtcttaagtttagtacctcacgtttaggctttgaccgaaagcttcgcaatgttagattacgctttgttaagacgcctgacgttactctgccggagctccggtcatgtaaaaaatctgattttaacagagatgcttggtctggacgatggactaggcttgggaagaatgatgagtgtcagattagcaatgacgggcgttaccgctgcctcgctgcggatttcccttgccggaaaccgtggtgcgacggtgcggttggagctatagagagtaatggttgggtttactctagccattgctctttcaagctcttctctgcggaaaaggcttgggattgcttgaaaggcaaatggattttcttctggggagattcgaatcatgttgattcgatcagaaacttgctgaatttcgtcttgggtcatcctgaaatccccgctgtcccgaggaggttcgatatgaagttttcgaatccgaagaacccttcggagactgttaggatcacgagtatctttaacggtcattggaacgagaccaagaactatcagggccttgattcgcttaaagacagggactttagagaattgctcaagaagtacttcaacgaagaaacaaaccgtgttcccgacgtgatgatcgtgaactcgggtctacacgacgggattcactggactagtcttagagcctttgcgaaaggtgctgaaaccgcagctgcgttttggagagaagtttttgacggggtcaaaagcagaggattgcaaccgccagaagtgattttcaggaacacaatcgcgacaggcgggtacgcgagaatgctagcgtttaacccgagcaaaatggaggcgtttaacggagtgtttctcgagaaaatgagggatgcgggattggtcacgagcgtagttgataacttcgatatgacgtatccgtggcactacgataaccgttgcaacgatggagttcattacggaagagctccagcgaaaatgcggtggagggacggtgagattggacatcagtactttgtggacttgatgctcgttcacgtattgctgaatgcattgtgtgtaagatagatgtggtaaagtttggtaattaggaagagtcacggattctttgtttatgtgtagacttaatttttttgaagtatagattattattatttgggaaaactcaactcaagcttgagttatattgtataatagcaagagattggagcaacaatagtgtactatatgtatctggttgacatttttctga

SEQ ID NO: 24 - DNA, 1192 bp, Arabidopsis thaliana
aaggaaaatggtccccaagagaaaacaaagggaacaagaaaagcagaaaaacataagaaacaaaggaaatgagaaaaagcctgagaagaaagtaataataatatgtctagaataagagcagatttgaagggcatgcttgttctttgtctcctccaccttcttcttccttctccttctcatgtcttttcattttcattttgttctttctgttcgccatttggtcttccacaatcggacccaccaaatatttgttttacgaatcttgaaatttcgtataagaatcgatcggaggaaggagaaaagaaacagagcaaagtagagagatatagagagaacaatggagatgaagagagacattagagtggaggaagagaacatgtgtacttcattgttgactgcagttgttgttctttcaatggcttgtcttaaacacttctcttctgtatcgtatttgatcgagcaatggcgttcgttggtgtttcttatactcaacgtcgttctcttagccgtttactttacctcgactcgtcctaacctcgggaggagtcatgatttcaagactcgtcgaggaggtagattgagaatgatgcgagagaaaaagaataagattaagaagaagaagacaagggtggtggtggaaccggcttgttttgaccaaggtttcttacttgttgagccaaaggaagtgatcaagaagtgtgttttagtggaggagacgaaaagagtttgccctaaatttgaggaaactgtgaaagattgcttgtttcacaagaaagaaatagagtataatggagaagaagatgaatttgagccagggaggttatccaatgaggagttgaacgagagagttgaagcgttcatcacgacgtttagacaacatttggtgctagatgcgagacgaggtagagacagagaaactgatcagaagatgagaccaaaagactctgacagtagctttttagttcgggaagtcacttgtttggtttaagagtttctctctacaatctttttttcatcttaagattcgttcggttttgttcgttctttggcttcgtttcttttgtgagtttgagctaatagctcaaaagatcgcatcttctttttttgatgtaatgccataagaacacaaaagtatattcaaaaaatttacataacaacaaaaaatcgaaaatataatcttcttcgaaatttt

SEQ ID NO: 25 - DNA, 1968 bp, Arabidopsis thaliana
tgtctccgcgccgcgttatcactcttacgtttctctctctctctcaacttcttccacagcaaatttcttcgattctctgagctctctcccatccttttcaagtggcttcgtttctaaaaaattgattggttgaagaaagtggaaacatggttgaatcggacaagtcatccgttgaagagctgaagaagagggttaggaagagaagccgtgggaagaagaatgagcagcaaaaggctgaagaaaaaacccacactgtagaggaaaacgctgatgaaacgcagaagaagagtgaaaagaaggttaagaaagtgagaggcaaaatcgaggaagaggaagaaaaggtggaagcaatggaagatggtgaagatgagaagaatattgtgattgtcgggaaagggataatgactaatgtgacttttgattccctcgacttatctgagcaaacttctatagctatcaaggagatgggctttcagtacatgacgcaaattcaagctggatcaattcagccccttttggaggggaaggatgttcttggtgctgccagaactggttctggtaaaactcttgcttttctcattccggctgttgagttgctgtttaaagagcgtttctctcctcgcaacgggactggtgtgattgttatttgccccacaagggaacttgctatccagactaaaaatgtggcggaggagttactcaagcatcattcacagacagtcagcatggttattggtggcaataacagaaggtcggaagcacaacgcattgccagtggttcaaacttggtgatagcaactcctggtcgtcttcttgaccatcttcagaatacaaaggctttcatttataaacacttgaagtgccttgtgatcgatgaagctgataggatactggaagagaattttgaggaagacatgaataagattctaaagattttaccaaagactaggcaaactgcgttattctctgccacccagacctctaaggttaaagatcttgctcgggtgtcattgacatcacctgttcatgtggatgtcgatgatggcagacgcaaggtgacaaatgaaggattggagcaaggctattgtgttgttccgagcaaacaaagacttatccttctaatttcctttttgaaaaagaacctaaataaaaagattatggtatttttctcgacttgcaagtcggtacaattccatacggaaatcatgaaaataagcgacgtggatgtctctgatattcatggaggcatggatcagaacagaagaactaaaacctttttcgacttcatgaaagcaaagaaaggtatcttgttatgtactgatgttgctgctcgtggtctcgatattccttccgtggactggattatacagtatgatccaccagacaagccaacggaatatatccatagggttggtcgaacagcccgtggagaaggagcaaagggaaaggcattacttgtcttgattcctgaagaacttcagtttattcgctacctgaaggctgcgaaagtacctgttaaagagcttgagttcaatgagaagaggcttagtaatgttcaatctgcgctggagaaatgtgttgccaaggactacaatctgaacaagttagccaaagatgcgtacagggcttatctctcagcatacaattcacactctttgaaagacatctttaatgttcaccgacttgacctcctggctgttgctgaatcgttctgcttctcttcgccgcctaaagtgaatctgaacatagaaagtggagctgggaaggtgaggaaggcgagaaagcagcaaggtcgcaatggcttcagtccttacagtccctatggcaagtccacacctacaaaggaggcataaagtgtcatttgtttacaaaattactattttgctccgtagttttgactaattaccaccaccaagttttgtttaaagagtaaacagtgcatttgatttaaatgaaatgttccttggc

SEQ ID NO: 26 - DNA, 1538 bp, Arabidopsis thaliana
aaaccggaataaatctttcgggtcaaaatttccgaaccctaactttagccccaaattagagagagatgcagaaacgggagcttgggaaatccggcggtaattccggtggatcttcgggtccaccagcgaagagaggccgtcccttcggtagtacaagtgctaactcagctgctgctgctgcagcggcggcagcagcggacgcgatgtcaccgtcagctttacttggtccttctcttctagttcacaattccttcgtcgagcagaacaatagaagaatagttcttgcgttgcagagtggtttgaagagtgaggtgacatgggcattgaacacacttacgttgctttccttcaaggaaaaagaagatattcgaagagatgtcatgcctcttgctaagatagctggcttgcttgatgcccttctcttaattatagatgattggcgtgacatagctctcccaaaggacctgacaagaggaactagagttagaactttaggtacaaatgcttcagttacgggatttggcaatgagtatgatgctctagcctctattcaaccccctggatccgggattggttcttctgctgctgaggcattaggaaaaaagagcactggtaaacatcagtcatctcagtggtggatggaagaggatggtttgtttaatctagacgatgaagggagatcagagaaacaaatgtgtgctattgctgcatcgaacgttatccgcaacttctccttcatgcctgataatgaagttgtaatggctcagcatcgccattgcttagaaactgttttccagtgcatacacgatcatatgaccgaggatgaagagctggtcacaaactcgctagagacaattgtaaacctagcgcatttgatggatcttcgaattttcagctcgcttaagcagtcatacatcaacataaatgaaaagaaagctgttcaagctgtggtcggaatcctcaattcttctgtcaaagcttggaattgtgctgctgctgagttgctagggcgtttgataatcaatccggacaatgaacctttcattagtcctttaattccgcagatacacaagcgactaatcgatcttttgagcatacaagccgttgatgcacaagctgcagctgttggagcactctacaatctcgtggaagttaacatggattgcagattaaagctagcaagtgagagatgggcggttgataggttgctgaaagtgataaagactccgcatccggttccagaagtatgtaggaaagctgcaatgatccttgagaaccttgtctcggagcctcaaaacagaggattgctactcgcgtatgagaatgctttcgctgagctgctttttcaagagggtaagtattctgattcatttgctaggattttgtatgaactcactgctagatctaatagcagagttgcttcagctagaggaatctggggcatgtaaaagtcttctctagattagtgggtttgattaattgattgtgttgtaaactttaatcatttgctatgtattaaaaaagcagtgttgttgaac

SEQ ID NO: 27 - DNA, 1199 bp, Arabidopsis thaliana
gtcctcggatttttctcgtgcttcactgataatccagcttgacgatgtcgttgacggagctagacgacggactggttcgcaggatggccatgggcgcagtcttctctgattttggagggaagatacattcggtgggtttccataggactgatgatctattggtcacatccagcgaagatgattcacttcgcctcttcgatatcgccaacgctaaacagctgaagattacataccataagaaacatggcaccgatcgtgtatgctttacccatcatcctagctctctaatttgctcttctcgatacaatttggagtccactggtgaatccttgagatatctctcaatgtatgataatcggatcctacgctactttaaagggcataaagacagggttgtatcactttgtatgtctcctataaatgatagcttcatgtctggttctctcgaccgaagtgttagactctgggatcttcgtgtaaatgcctgccagggaattctacatctacgtggtagacctgcagttgcgtatgaccaacaaggccttgtgtttgcaattgcaatggaaggaggtgctgttaaattatttgattccaggtgttatgacaagggtccctttgacacatttctggtgggtggggatactgctgaggttaacgatataaaattcagcaacgatgggaaatccatgctcctaacgactacaaataacaatatctacgttcttgatgcatatcgtggagagaagaaatgtggttttagtttggagccttcacagggtacacccatagaggccaccttcacaccagatggcaagtatgttctgtcaggttcaggtgatggaaccttacatgcgtggaacatcgagaacccatctgaggtggcgaggtgggagaacaacataggagtagtgtcgtgtctgaaatgggcaccacgtagagccatgttcgttgctgcttctacggttctcacattctggatcccaaacgacggtgaatcaccagcccccgccgatcctcctaccgatcaacaacagtgacgacatatatgtttccattatgcacttgtgtatcgttttttaatgttgacaattagaaaaatttggaagcagtagtatgttaatcaaatttagagtttatgaatttgagtctagatggttacaatatgttttctttaatgactatttactcttattttacgt

SEQ ID NO: 28 - DNA, 1827 bp, Arabidopsis thaliana
aaggttagcgacggtgttaacttgtaaagttgttgtaatcgttttccagacgacatagtcgtgtttcggagtttctgaaatttgtaaaaatcgaaagattggcttcgcaatcgagacaaggaacaactctagaacatggatgaaagagatcgagaaattcgtgcttctcatggtgattctaatgctggtaatgtcgttagtcaaagcatagagaatactagagaagaagattctggttcatgtgaaggctttgttgaagagagcaaaagactggaaccggaacaacaaaagcatggtaaatattttttctatgacacaccgctttctgaggaaaccggggtttggatacctgtttcagtcccacccatgttagaacctgatcatgaggaatggtcaagaggtcttagtttcaatggtggttacttccctgaaggagatatgggatgggaccagatatttgatgaagataaggagttaactatgtgggatgtgatagttgatatgttacttgcagcgcgtggtaaagcgagtgctcttagttctggcaaccttgagagatgtggcattaattttttgtcgggacatcttcttgaacaagcttggcaagatatggctcatactcttactgaggctaactttggtaatgcaagagagattctggagactgagccacccaagtggctaccggatagcgctgcttctgcttgtatgctatgtagtgtgaggtttcatccaattatgtgttcccgtcatcactgtcgatattgtggaggaatattctgtagggattgttctaaaggaaaaagcttggttcctgtaaagtttcgtgtttcagatccccagagggtttgtgatgtgtgttttgtgaggttggagtctgtgcagccttatttgatggaccaagtgagtcctgctgctcagttgccaacccatgacttgacagatcttagtacgttgaggtcttgggtgaattttccatggggacaatccatggagtatgagatctataaggcgacaaacactcttcggggttatataaccaaggttggttcttcgagaactgagaggtccatcccagatgccattttaagacaagcaaaaggtcttgcagtaatcactgttgccagagttggagttatggttacatataaaatcgggactggacttgtggttgctcgtagagatgatggctcctggtctccaccctctgccatctcttcatttggtttgggatggggtgctcaggcaggaggagagttcatagactttattatcgttctgagaactcgtgaagccatccaaacgtttgggagtaacacccatcttgttgttggagctggtttaagcgctgcagttggtgtgactggacgagcagttgaagcggatatccgagcaggtagtggtggatatgctgcttgctacacctacagctgcagcaaaggtgcatttgtcggatgctcgcttgaaggaagcattttcacaacacgtacaagtgagaactcacggttctatgggagccagtccctagctgcgtctgacatcctccttggctctttgccaaggccacctgccgctgctgcactctaccgtgcgcttggcgatctgtatcagaagatggggagtgaaactgttcggtctccggcaatttctccattgtctgaagactaaacttgttcgattcgcttcatctcgttggaagaatgattgacaactatcttgtatagattcatgcaattcttgaatgtacatagtttgtggaggtttgatagtatgtggtttgtaaataaacatacattattatctgaagttataaattgtttcatactt

SEQ ID NO: 29 - DNA, 1480 bp, Arabidopsis thaliana
tcgctgcccgaaaagaacatacagaaagacactttcacatttcacacttacagagagagagaagagagataaagagagcatttagatatcttgaggaagacgaagaagaagtagaggagagatatggttccgagcaacaatagatgcaaatggagttccattttcttgtttctgctcagtgtctccgttgccgtcttagtcgccgtcgctgacgacaagtctccggcggttgaggatggtttagtgatcaacggcgacttcgaaacatcaccgtcaagtggctttcctgacgacggagtaactgacggaccatccgatatcccaagctggaaatccaacggtacggtggagctaataaattccggtcaaaaacaaggcggaatgatcctcattgtcccacaaggccgtcacgccgtccgattagggaacgacgcagagatcagccaagatctaacggttgagaaaggttttgtctattcagtcacgttcagcgctgctcgcacgtgcgctcaactcgaatcgataaacgtgtcggtagcgtctgtgaacgcagacgcggacgatatgctggcgtcgcggaacgttgatttgcaaacgctttatagcgttcaagggtgggacccttatgcgtgggcgtttgaagcggaagatgatcatgtacggttggtttttaagaatccgggtatggaagatgatccgacttgtggaccaatcatcgatgacattgctattaagaagctctttactcctgataaacccaaagataatgcggtgattaatggagatttcgaagatggtccatggatgtttaggaacacgtctcttggtgttttacttccgacaaacctcgacgaagaaatctcgtctcttcctggttggactgttgaatcgaacagagcggttcggtttgttgactcggatcacttctctgttccaaagggcaaacgagccgtcgagctactctcaggcaaagaaggaattatttcacaaatggttgagaccaaagcagataagccgtacatattgtctttctcactaggccacgcaggtgataaatgcaaggaaccattggctattatggcattcgcaggtgatcaggcgcagaactttcattacatggcgcaagcgaactccagtttcgaaaaggccggtttgaatttcacggctaaggctgatcgaaccagagttgcgttctacagtgtttattacaatacgaggactgatgatatgagctccttgtgtggacctgtgatcgatgacgttagagtgtggttctccgggtcgaagagaatcggagctgggtttgggttttgggtttttgttcttctcgttgtcggtttggtttaagtaactcaaaatttagatgttccggttttattctagtgtaccagtaaaatgttgttgcaaaccaagaagaattctgtatggtttatttatccatcgggttaaagcaaattcgaaggtgtttatcgttatgcaa

SEQ ID NO: 30 - DNA, 1531 bp, Arabidopsis thaliana
gtcttctctcttctcctcttatctctttctctaccattttcttttgctttaaagctctctcaatcatgatcatgaagacccccatcacagcattccattcatcctcatgaataattctacatcagtgaagaggctggtttcatctaaggcaatgaaatgtttctacttcagcaaagacaaaactcaggatgatgaagctaagactagaaagtttggttcagctacgatggctagaggaggatcagggtctgagtttaattcagatacaagtactgctacttccattacttcttccttgcacgtcctctcagagacacacagtaataatctcaaagtatttgtcctcgatgaccttaaaaccgctaccaagaacttcagccgctccttgatgatcggtgaaggtggctttggtggtgtctttcgtggcgtgattcagaaccctcaagattctcgtaaaaagattgatattgcagttaaacaacttagtagaagaggtctacaggggcataaagaatgggtgacagaggtaaatgtattgggagtagtggagcatccgaatctggtgaagctgatcggttattgcgctgaggatgatgagagagggatccaacggctacttgtttacgaatacgtacaaaacagaagtgttcaagaccatttatccaatcgttttatagtcactcctcttccttggtccaccagactgaagattgctcaagacactgctagaggactcgcttatcttcatcaaggcatggagtttcagatcatctttagggatttcaaatcctctaatatccttcttgatgagaactggaatgcaaaactctcggatttcggactggctcgaatgggtccttcagatggaatcactcacgtttccaccgcggttgtagggaccattggttatgcagcaccggaatacatccaaacaggacacctcacggctaagagcgacgtgtggagctacggaatctttttatatgaactcatcacaggaagacgaccttttgaccgtaaccgcccaagaaacgagcagaacatcttggagtggatcagaccacacttatccgacataaagaagttcaaaatgatcatcgacccaagacttgaaggaaactactacctcaagtcagcattaaagctagctgcagttgctaaccggtgtttgatggtaaaagcgaaagcaaggccaacaatgagtcaggtttcagagatgttagaaaggatagtggaaacatcatcagatggtgctccttcaggactgccattgatgaaaagcttgacacctaaagatgcattcgaagcctcaagaagggagagagttaagagaagatttgttgaactgttaattggagaaaatggttgtcccaatttacctacttggtctcataaacttgttacttctatttgatttttttgagagaacaaactgataatcacactgcttgtgttatgccaatattaattgccattataatcacttgtcgtttctataaataaaacggcccgcagttttgcccacaataaa

SEQ ID NO: 31 - DNA, 2504 bp, Arabidopsis thaliana
ataacctaaaccaattgcatggttagaataaattagtaaaatatctcatagatgcgatcaagcgtacaggactttgaaaagcgttaattattgtttatttcttatttaacatgttgtttaactggactaagtaattatttatctcagcttttataagtaactttccaaaagatagtcaaaaactctcactcaatcgatggcagaaccatcttttgctcgtctgtttctcttgttcttcagctttctccttatctttgccacctactcttgggtctttggacccgactcaggcttcttgttcggtactcgtgtccggaaaactctcggctcgaatcgtcaagtccacgttgaccactctttagaaaagcctcatcatccacttgatccactaacggtgcgagaaatcaatagagtcagaacaatactctcgaaccatgacccgggttttggttccgggtcggccacgattcactccatggctctcgatgagccggagaagtcacgtgtcgtccagtggaagaagggaaataagcttctgtcacgaagagctgcggtcgtagcttattggggtggtcaaacacatgagataacggtggatcttgattcgggtcgggtagtttctgatgtgattaaccggacttcagggtatccgattctcaccttgaacgacgtcttcgctgcttcgcaggttcctttgaagagcttggaatttaaccgctccattgaagctcgtggggttaagttttccgatttagcttgcatcacaccgtttgccggatggtttggatcggaggaagaaggacgtagagtcataagagttcaatgtttcacgttacaaggcactaccaattattttatgagaccactcgaaggactttatgtaacggtcgatctagacaaattggaggttatcaagatcatcgataaaggcccaattccaattcccaaagcctccggtacagaataccggtttggtgttcagaataaaccggtgcatatggatcgtattaacccgatttcgatggagcaacctgacggtcccagttttagggtcgaagatgggcatttggttaagtgggctaattgggttttccatgttaaagctgaccaacgagccggtatgatcatatctcaggccacggttcgtgactccgagacaggtgaaccaagaagtgtgatgtacaaaggattcccatcagagttgtttgtaccgtacatggaccctgaggaaggatggtactacaaaggttatatggatgcaggcgagctcggtttaggacccacggcaatgccgctcgtgcctctcaacgattgccctcgaaattcttactatatagacggtgttttcgcctctccagacggcaaacccattgttcaacctaatatgatatgcttgtttgaacgctatgcaggcgatatcagctggcgacattctgagatcctttttgccaatgccgatataagagagtcaaggccaaaagttacattggtagctcgaatggcaacttcggttggaaattacgactatattttcgattgggagtttcagactgatggtttgatccgtgttacggtcgcggcttcgggaatgttaatggtgaaagggacaccttacgataatgtagatgacttaggtgatagggaggatgatgctggaccgttgatctctgagaatgtgattggagtcgttcatgatcatttcataacgtttcatctagacatggatattgatggaccgatgaataattctttggttaaggttcatctagagaagcagagagttccaacaggaaaatcgccaaggaagagttacttgaaggtcaagaaatatatagccaagactgagaaagatgctcagatcaagttgagcctctatgacccatatgaattccacattgtgaacccgaaccgaaaatctcgggtaggaaacccggctggttacaggatcgtaccgggtggtaatgcagcgagtttgcttgatcacgatgatcctcctcaaattcgaggtgcattcactaataatcagatatgggtgactccatataaccggtcagaacaatatgccggaggagttctaatttaccagagccaaggtgatgacacactacaagtttggtcagaccgggaccgttcgatcgaaaacaaggacatagtactgtggtacacactagggttccatcacgtaccttgtcaagaagattatccagttatgccaaccgttgcggctagctttgaacttaaaccagcaaatttctttgaatccaatccgattcttgggtctgctcctttcttcgaaaaagacttaccggtctgtagaccatttgcttcatcttgaccggttctgttctgactaatactctaatagtatacaagtagagaagatcaaatatccggtgtagccaaacacttgttgaagtttatttgccggtttttgcaataataacaaaacgtccaatatctgtaatccccgacgtaacataataccaaaaatcttcagtttcttc

SEQ ID NO: 32 - DNA, 2302 bp, Arabidopsis thaliana
aatggctatatgattacagtagcccccttcgtgtctcttcgtttccagttccctctttatataataaatcgctccactctctttttccgagaaagaacacagtatctcgtctacaacacctgtcacattttgagaacaacggcgaaaacaatgccggtggttgctgagtacgcgaagtcgaatcggtcgtcgtgtaggtcatgttcgaacaagatagctgtgaaatcgcttaggttagggttgattagcaaaggacgtggcggggttgacatgaccaggtggcaccatttcgattgttttccgactgattctgagtcgattgcttccgttgatgatattcaaggcttatccgctttagagaaagaagatcaagatgctttgacgaaattggtggaacaatgtggtaaagtacctgcaaaaaaacctgatgagaagaaggggaaggctaaaaagcatataatggggccgaaggggcttacgaaggcggcaacatcttcaaaagttattgctgataatgcgaaatcgagcagatcatcatgcaacaggtgttctcagacaatcgtttcaaaggatctgagagtggggctggttactgaagactccaggggatttgatataacaagatggcatcacttgggttgttttcccattgattttcatccaattgattctgtggaggacattggtggatattcatcgcttgagaaaggtgaccagatggaattaaagtatttggccgaagtaaacaagaaggataaaactttgatagatgatgtccagaagatggatgaaggtgatgatgaagctatagctgataatgagctaacggaggagaccaaaaaaggaaaacattctcctgttgcaaaattggtggaacaacctggcgagcctgcaaaagaagatgaggatgaagagagtaaaaagcctgcatcagatgaaataagtgagcagaagactaaggatgtgaaaaattctcctgattcttcaaaagttatttctgagtatgcgaaatcgagcagatcaacatgcaagaagtgctctcagactatcgctgcaaaggaactgaggttggggctagtgaccagaaacttccgtggctttgatatgaaacaatggcatcacttgggttgttttcctgtcgactctgatccaattgtttcggtagaggacattggtggattttcagaactgcagagtggtgatcaggatgcattaaaggaattggtccaacaatgcgggaagcagactttggtagataagatggatgaagataatgatgacactgaagctaaaattaagctaactgaggagacaaacaaaagaaaacattctgaggttggggagatggtggaagaagatgaatcgctaactaaagcgaaacaacagatggctaaaacacataaggtgaacatgagtgagtcaacttctcaggtcgaggttgaagcagaaatcactctttcagcgtctgatgtgaaggataagtacagggatgccaatctattaccaaaatggaaagcttttgagacagttatattccttgagcgggatgatggtcttaatgattcagaaaaaatagctgcatttgactttgatggatgccttgcaaaaacatctgtgaaaatagtaggggcagatgcatggtccctaatgtatccttccattcctgagaaactgcaaagtctgcacgatcaaggctataagctggtcattttcacaaatgaatccaacattgatcgatggaagaacaagcggcaagctgctgtagattcgaaaattggacggctcaacagttttatcgagcgcgtgaaggtccccattcaggtgtttatagcctgtggagtctcaagttctggtggtaaaggtggtaaagatgacctttaccgcaaacccaaggctggaatgtggcaactcatgaagaagcattttaactctggaattgcaattgatatggataaatccttctacgttggggatgcagctggaagaaaaatggatcacagcgacgctgacatcaaatttgcacaggcgagtgggctaaagttttttaccccggaggaatactttatcccctcaagtacatcgccagggacttagctgtatcagtcttgtgcttgtgtttgcagtttgcaacttcttttgcttttttttttgtgatgaaactagtagctagcttttgtgataaaactagtagtgtgcttttgtgatcaaagtattagtatgtgttttaactctttttgtatattactgatatttaagcgtcaactagagcttattgaaccaggaaaaagaaactcctttgaac

SEQ ID NO: 33 - DNA, 1091 bp, Arabidopsis thaliana
gaaagaaagagaaagcagaacatgcagggagcatgcatctccgagagtcagccatggtatctccatttcgtatgcttcataggctttctctttctccttagagtactattcattcctctcctaaaatggttcaccacaagattcctcctcacacccaagcggctcaagcggtacggctcatgggctatggtcactggagccaccgaggggatcggacgcgcctttgctcacgagctggccaaacacggccttaacctcatcctagtcagcagaaacctttcgaagctcgaatctgtctctgatgatttccaacaagagtttccccacatcaagatcaagatcattccatttgacttctcctctgaaggaggatacggagcaatcgaggaagggataaaaggccttgaagttgggattttgataaacaacgttggtattacttatccacgcgccatgttcttccacgaggttgaccaacttacatggaccaaaatcctgagggttaatcttgaagccaccacttgggtcacacgatcactcatcggaccaatgcttcaccgccgccgtggagccatcgtcaatattagctccggcgctgccgttgttgtcccttctcatcccctctacgccatctacgctgccaccaaagcttatgtggatgcactatcaagatctctacatgtggaatataagcagtttggtattgatgtccagtgccaggttcccttatacgtgtcaacaaggatggtgtcagaagtggcagctatagacaaacctagcttatttgtaccgtcgcctgaagtctacgcaaaagcggcggtggcgcagatcggaattggatcacgttgctcgccgttttgggctcattctcttcagtggtttcttgttggacttgtaccggataaccttgttgatacttggcgtctctctatcggacttcgcagaagaagtttatcttaatgatcatattttcaagtttgtatttgctcctccacctttcgtggataaatatatggcccattgggcctgacagaaaaaacttatagaacacaatttgccctttaataatatttcaatgtgacataaaaaaa

SEQ ID NO: 34 - DNA, 795 bp, Arabidopsis thaliana
acagagaaacagagttttctgttttagcgagattggaaacttggttttgagcttaacattaaatggcggtcgtcatctccatccatcgtccttatgtaaccctcacaatctctaaaaatcgtaatcctcttaaacctcaccgacaattcaacgaatcctgcctgaggtttgatcatcttcctcggaacaccaaaaatcagctccgttgcttatctgcgaaatcgacgccatcgaaaccagaccctgcatcccctcaagatggggaagagctggagagtgtgggagtcaaagcagctttagcaatgctgagattctacaagagagagatatcgccggtgttacctagaagctgccgttacgttccgacttgcagtgaatactcaatggaagcttacaagaaatatggagttcttaaaggcactgttctcacaacttggcgtctctgtcgctgcaatcctcttggtggatctgggttcgatcctccaagatggtttggtgagagtgggatcaagctccgagaaggagacgaagaagaagaagataactatgacgacgaagatcaaagaaagatttgaatgaatttaagacaaaacagtagaagttgtacactaatactagagaaagcaatgggaaagctagcagatgtagaacaaagttttttgtaactacgagagaataagaatacatttgtttccaaaaagatttgatcttttctgtcttttggagcgatacatttaagtagacagatcttggaattgccatgggttgaattggatcgacttagggtcggtgtta

SEQ ID NO: 35 - DNA, 1107 bp, Arabidopsis thaliana
gactcttgtaatagtataaaattttattgaataattcatctgtagacaagggggaaaagaaagactgattttacgctttattgctctcactaaaaccctaattctctccgtctcgatcgcgacctctgtttcttcggcaatggcggattctcctcaaagaagaagggattcacgatctccttcaccccgaaaagaacgagctagatccagatccaggtctaggtccaggtctagatccaggcccaggcttaggtccaggtcaagatctttgccaaggcctgtttctccatcacgaagccgtggaaggtcaaggtcaagaagccgtggaagaagtgaagttgaaaaccctggtaccactctctatgtgactggcctatctacaagagtcactgacaaggatcttgaagcacatttcgccaaggaaggaaaggttgcgtcttgttttcttgtgatggagccgcgcacccgtgtgtctcgtggttttgcctttgttacaatgagcagccttaaagatgctgagcggtgcattaaatatctcaaccagtctgtactagaaggccgatacataactgtggaaaggtccaggagaaagcgcccgagaactcccaccccaggccactatcttggcttgaaaagctccagagacagcgatcgagaaggccgtagcagtcgagggaggcactatgatcgtgatgattacagagaccgtaggtcaccaagacgcgactattcacctcgtgatgaaagaaggtctagaagagatcggtcttactctcctcatggaagaagcccagagagaagatcagagagaaggtctgagaggtcagagagaaggtatgaaccccgtggctcgagatgacctgttttcatccttttgacaaaggattcaaaaacttctctgttgatttaggttgtgtaattgatcatccttaaaatagcacaaagattctgtcaggcaacgctttgggtttcatttattttctgttgttaacgtgttattctgtcggaactctctgaagtgaaaactaaaaactgtaatagcttctctgttatgtctctactctacttgtttttgaatgaatcagaatatcttatgtgattagaatc

SEQ ID NO: 36 - DNA, 1303 bp, Arabidopsis thaliana
atgaaataaaaagaagcatcttctagagagagacatatagagaaagagagagaaagctttagggtttcaaaaaaaaaaaaaaagagaccctttagaaatctcctaacaggaaagttttctcaattgctatagaaaatgggagtcatgatcaatcaccatttcctcgcttttatcttcggcatcttaggaaacgtgatatccttccttgtattcctcgctccagtgccaactttttatagaatatacaagagaaaatcgacggaaagtttccagtcgctaccgtaccaagtgtcgctatttagctgcatgctatggctctactacgcattgattaagaaagacgcttttctcctaattaccatcaactcctttggctgcgtcgtggagactctctacatagccatgttcttcgcttacgccaccagggagaaaaggatatcggctatgaagttgttcatagcaatgaacgttgccttcttctcgttgattctaatggtaacacatttcgtggttaaaactcctcccctccaagtctctgtactcggctggatttgtgttgccatttctgtttctgttttcgctgcccctctaatgatcgtggctcgtgtgataaagacaaagagtgtggagtacatgcccttcacgctttctttcttcctcactataagcgccgttatgtggttcgcttatggtttattcctcaatgacatatgcatagcgattccaaacgtggtgggattcgtactagggctgttgcaaatggttttgtacttggtttacaggaactcaaatgagaaaccagagaagattaattcgtcagaacaacaacttaagagtattgtcgtgatgagtccgttaggtgtgtcggaagtgcacccagttgtgacggaatcggtggacccactctctgaagccgttcatcatgaggatctgtccaaagttactaaagtggaggagccgtcaattgaaaacggcaagtgctacgtggaggctactcgtcctgaaaccgtttgaagtgtcaatatgtgaagctcaaaatattgctctctctctctctctctttcactctctttctctcggctcgtcagggccggccaaaggaagaaattgtattatcggcggggtggtttgttaaatttccatttttgtttcgtatcttattgatgatgtactacttgcataaagttttgtgtttatttgaatatattatctttgtgtaagttgtaactagtgctctttggaaaatttgatataataaacctcaatagcttaattactcctactaataagctttttttttgtt

SEQ ID NO: 37 - DNA, 1894 bp, Arabidopsis thaliana
aacacaaaacagtaatctctcagactacaactttactcacttcaccagctctctctcacttgatgacaatgggcgactctgacctccgtaaacctaccaatttcggcaccggacatctatctcgccgacgatcatggtgttgctctttcgccgtacctccagcgagtcctgatactcgttcgatttcatctcgtaaccacattccagctaaatctcagcagcagagacctaaactggttccttgctcaccgcaaagctctaaatctgctttaaacatcgtaaatcggatcgacccgcgtcggatcttatcaccgggtcgggtttcacccatagattcggatccgaccgtcactacaatgcaagagaccgagaccactcaggaagaagaagatgatgcggttgttgtagattcgacaccaaatcttcgttctgagagttttagagctccgaagattgaggttacgggttcgggtttgagtgagggttacgatgctaggttgagtttgaagggaagaaatggtggtggggttctggtgttggagcttagcttggaggttttggctgcgaattctgatgtgttctcgggtttgattgcggaggagaagaagtgttcttcttcttcatcgtctttaggattgaagaacacatgcaggattgaagtatgtgatgtggagaatcttggtgtttttagggaaactgttgagctcatgtttgaggaaagtaatgttattatcaagaagtttatgacaatgggagtctacagagccattgatgtacttgaggtagcggctggaatcaaattttcaagagctgtcttatcgtgtctgaaatatcttgaagctgttccttggacagaggatgaagaggaaaaactgaggagacttcttggaatttatagctttgatgatgatgcagttagtgaaattttggcaagatttaattcaaacgagacagaaaacttgcaagacagtttatcgaagaaactggtttggtcaattacttcctgcagtgatgtaaatcctagaaacgagctcaaatctctggtgaagggtcttctttgcaaaagctcagtgtacgagaaagaacagcctgagatcaacaaggaagacatatatagagcaggcaagtgttgtgtggattcattagctaagttgtttgaagagggcagtagtagtagtagtagcaagaaagaaaagccattgattgaaagtatttcgagggaggttgagaacataaactggctgctggagatcatgatagatcgggaaatagcagaagaatttgtggaaatatgggggaagcaaagaaggctagtggagatgcatgagagagtgtcaccaatggtgaggtatgaagtaagcagagtaacaggagcgatatttattgcaatggggaaaaggagagtgcaatgcggaggagaagcaagggcggggctagtagaagcgtggttcaagccaatgttagtagattttgggtggctacagagatgcaagaaaggactagacatgagggaagtagaagaagggatggggcaaacgcttttaacgctaccagtaaaagagcagtatcaagtgttcatggaatggttcaggtggttctcaaagcatgggactgagtgccctaatctcagcaaggcgtttcagatatggtggcgtaggtcattccttagaggtgtagaatcatctacttgtaggtaaacaaattattccaagtgttcaagaggctattatgtatgttaggttttagcttttgtggaaatttagactgtaatataactctctctccttttgtctccacccgcatgatatgttcgtttcggatgttttttggagctaaattagtcgtaaggtttgaaaaagcaacaagtacaaaacacaaaatggtactttctttc

SEQ ID NO: 38 - DNA, 1235 bp, Arabidopsis thaliana
atatctttataaaccccaaatcaaaacctctcctatatctcttcaatttgatataactacccttctcaatggcttctaattaccgttttgccatcttcctcactctctttttcgccaccgctggtttctccgccgccgcgttggtcgaggagcagccgcttgttatgaaataccacaacggagttctgttgaaaggtaacatcacagtcaatctcgtatggtacgggaaattcacaccgatccaacggtccgtaatcgtcgatttcatccactcgctaaactccaaagacgttgcatcttccgccgcagttccttccgttgcttcgtggtggaagacgacggagaaatacaaaggtggctcttcaacactcgtcgtcgggaaacagcttctactcgagaactatcctctcggaaaatctctcaaaaatccttacctccgtgctttatccaccaaacttaacggcggtctccgttccataaccgtcgttctaacggcgaaagatgttaccgtcgaaagattctgtatgagccggtgcgggactcacggatcctccggttcgaatccccgtcgcgcagctaacggcgcggcttacgtatgggtcgggaactccgagacgcagtgccctggatattgcgcgtggccgtttcaccagccgatttacggaccacaaacgccgccgttagtagcgcctaacggtgacgttggagttgacggaatgattataaaccttgccacacttctagctaacaccgtgacgaatccgtttaataacggatattaccaaggcccaccaactgcaccgcttgaagctgtgtctgcttgtcctggtatattcgggtcaggttcttatccgggttacgcgggtcgggtacttgttgacaaaacaaccgggtctagttacaacgctcgtggactcgccggtaggaaatatctattgccggcgatgtgggatccgcagagttcgacgtgcaagactctggtttgatccaagggatgtgagtaagacacgtggcatagtagtgagagcgatgacgagatctagacggcatgtgtagtcaaaatcaagttgcacgcgagcgtgtgtataaaaaaatctttcgggtttgggtctcgggtttggattgtggatagggctctctctttgctttttgtcgttttgtaatgacgtgtaaaaactgtactcggaaatgtgaagaatgcatataaaataataaaaaatcattttgtttctact

SEQ ID NO: 39 - DNA, 1586 bp, Solanum lycopersicum
ataaataaatatatacatcacatttttttctccaatttttttgtttttccattctataatggctggaatgtgttgtggagttaatatagccgaaactgaggctactacaccagttgagcctagttcagaatctgcgaggagaagaagaatggaaattcatcaattccgttttgtacctaccgatgttgcagctgcaacacaggaaaaaaatggacggaaaaggcataagattgacaaagttattgataataacaagaggcagaaattggaaagcagtgtaacgatttcgttggcggtaactgatgaaaggaatgaaaatgaagtgttggatctgtctgaatctggttctcaatctgttgaaattgagcctgatttacccaaatatgggatgacttctgtatgtggaagaagaagagatatggaagatgcggtttcgattcatcctttgttttgcaaagagaatagtgaaaactcaagcaatttacatttcttcggtgtttatgatggccatggctgttctcatgtggcgatgaagtgtaaagatcgaatgcacgagatagtgaaaaatgaggtggagaaggaagaaactcaatggaaagaagcaatgattcagagcttttcgttaatggataaagaagttgttaattattctactagcgtacttccatcttctacctcaggttccaattgtagatgcgagcttcaaactccacagtgcgatgccgttggatcaactgccgtcgttgccgttgtaactccggacaaaatcatcgtttccaattgcggtgattctcgtgccgtcctctgtagaaacggcgtcgctattcctctttccgttgatcataagccggatcgacctgatgaattgaatagaatacaagaagctggtggccgtgttatatattgggacggagctagagttctcggcgttttagcaatgtctcgagccattggtgacaattatttgaaaccatatgttatatctgaaccggaggtcactataacagatcgaaccaacgaagatgagtgtttgatattagccagtgatggattatgggacgtggtatcgaacgagaccgcgtgtggcgtggcacgtatgtgtttgcaatcgagacggccaccgtctccggcgggatcgccgggaaatgatattacggtgaccggcgccggagaaagctccgacaaggcgtgttcagatgcatcaattctattgacgaaattagccttggctaggcatagtagtgataatgttagtgttgttgtggtggatttgagaaaaaatctataacagtatgggtgcttaattagtactagttttaatcataattaattaattaagtgtataattaaggggaaactctaattttaggttttaattgtcatgggtttagctaatgaagctaagattgaagatggtttgatttattagtttagctgatttagctgcctttgttgatgattagtattgctaattattattattgttattattatatattttagagaaatggagatgagaaattgtaaagaagtggatcttttttccaactgtcccagattttatgtgaaatatagaaaatacaaaa

SEQ ID NO: 40 - DNA, 878 bp, Arabidopsis thaliana
aaaagctgacatggcagtgaattcagttttataaaaaaggcttcaaggccgagagttcgtagtacaaactcttctctcagtcatcacagaaaataaaaaacaatggcgaataagttcactagacaacagatttcagagtttagggaacagttcagcgtatacgacaagaatggtgatggtcacattaccacagaggagttcggtgccgtgatgcgttccctcggtttaaacctgacccaagctgagcttcaggaggagatcaacgattcggatttagatggtgacggaaccatcaatttcactgagttcttgtgcgcaatggctaaggacacttactctgagaaagacctcaagaaagatttcagactctttgacatagacaagaatggtttcatctcagctgctgaaatgagatatgtgaggactatcctccggtggaagcaaactgatgaagaaatcgatgagattatcaaggcagctgatgttgatggtgatggtcagatcaactacagagagtttgccaggcttatgatggccaagaatcaaggtcatgatactaaatatgacacaactggtggcactttggagagggacttggcggccggggttgccaaaaatatcatcgcagcgccaatgaccgacttcatcaaaaatttgttcgaagcgttgttttcttgaaatggtacatcagtaactttatgccattagggtctggctggtatgttagatctctctaaaaaggcgtttgatctttgaaaataatttctatgtaataaatttattgtgttaccatcttttcttgcatgcaatttattaaaatgagtttgtaatatggtttcagtatcgaatataattggggtatcaatgtatcttttgag

SEQ ID NO: 41 - DNA, 1867 bp, Arabidopsis thaliana
atagagagagactagtgagtgagagagtccatcgctttctttctttctctctctcgctctctcttcatctccaacagagacttctttctagagaaagagatcttcacaaatatgactgtgatgaatcaccgacacaagcaatgtcattttctcctcctccttctgatcactgtcttctctgccgcgttggatggtgtttcttccgagacagacgtcggagggtttgactacggtgaagcattgtctaaaagcttactctactttgaagctcagagatcaggaagacttccgtacaaccagcgcgtgacttggcgtgatcactctggtctcaccgatggtcttgaacaaggggttgatttagtgggaggatatcacgacgccggagaccatgttaaatttggacttccgatggcttttacggtgacaatgttgtcatggagtgtaatagagtacggtgactcactcgcttccaccggagagttatctcacgcgcttgaagccatcaagtggggaacagactacttcatcaaggcacacacaagcccaaatgtcttatgggccgaagttggcgacggtgacactgaccactactgttggcaaagaccggaggacatgacgacttcacggagagctttcaagatcgatgagaataatccgggatcagatatcgctggagaaactgcggcggctatggcggcagcttcgatcgttttccgttcaacaaatccacattactctcaccttctcttgcaccatgcccaacaattgtttgagtttggagacaagtacagaggaaaatacgatgagagtctaaaagttgtgaaaagttattatgcctcggtgagtgggtacatggacgagcttttatggggtgccacttggctttatcgagccaccgacaatgagcactatatgagttatgtggttgacatggctcaccaactaggtggcctttcttgggccatgtccgagtttagctgggacgtcaagttcgccggtgttcaactcctagcttccatgttgctaaaagaagaaaagcacaagcaacattctaaagtcctacaacaatacaaatcaaaggcggatcattacctatgctcaattctcaacaagaacatcaacggcacaaacgtccagcgaactcctgccggtttactctacgtccgacaatggaacaatatgcaatacgtatccacagcatctttcctcctaaccgtatattctgatcatctccgaaaatcaaacaccgatctcgagtgtcacgaaggaaccgtaactcctgacgagatgcttggctttgcgaaatctcaaatcgattacattttaggatcaaatccaatggaaacaagttatctagtcgggtacggtccaaaatacccgattagggttcatcatcgaggcgcgtctatcgcttcttttaaagagcacaaaggttttataggatgtactcaaggatatgataattggtatggacggtccgagccaaatccgagtgttttagtcggggctttggttggaggaccggatcaccaggatgattttgatgaccggaggggtaattacgttcaaacggaggcttgtacgtacaatactgctcctttggtcggtgtgtttgcgagacttatagagcttgaggagcaaaaacttgaagaagaagatgtgagcttggttgcaacttataagagatagtttttatttaatcaatacaaaaaaaagaaagaaaatgtggttttattttgcacccattttgccatttctatattgttagagtttttcttctcaactttttttttttgttttgtttttaaataaaaagtgtgtataaaatatcaattatcaatatagatttttgtcaattttattagtt

SEQ ID NO: 42 - DNA, 959 bp, Arabidopsis thaliana
cgcaaaagcacatgtgatagtagccgacagtttgaagtaaagccagcaaatcgtgaaagccatttacttttagatctctctctgcactctctgactttgtccgcaaagtagatctgctgcaatggcttctcctcttctcccaacttcgactactcctgatcaacttcccggcggcgatccacagttgctgagctctctacgcgtcctcttgtcccgcgttctagccaccgtccgtcacgcttctgcagatgccagaccctgggcagagctcgttgaccggtcagcgttttcccggccaccatcgctctcggaggcaacgtcacgagtaaggaagaacttttcctatttccgagccaattacataaccttagtggcaatcttactcgccgcgtctctgctcacgcaccctttcgctctcttcctcctcgcatcgctggccgcttcttggcttttcctctactttttccgtccggcggatcagccgttggtcattggaggacgcacgttctccgatcttgagacgctagggatactctgcctgtccactgtggtggtgatgttcatgaccagcgttggatcgctcttgatgtccactctagcagttgggatcatgggcgtggccatccacggagcgtttcgtgctcccgaagacctgtttcttgaagaacaagaagccattggatctggacttttcgcattcttcaacaacaatgcctctaatgcagctgccgctgccatagccacctcagcaatgtcacgcgttcgagtctgagattgttgaagagactacattcctacaccgcatttccaaagtgtgatatttattcatattgaattgttgtaacttgtaaccattcttttgtcatttctgttttgtttactttgttgctggaattttgaaacacaattcatcttactatacaccattaaaacgagagtcagtaaagaagaattttact

SEQ ID NO: 43 - DNA, 1096 bp, Arabidopsis thaliana
accagtggagcgaagaagcggaggagggaagagggatgcgatcctctcgtcatcgctggttccatcagtttcagtgagaatcagatcgtcgttgtactgagagctccggcattggttcacggcggagctggagagttatctaagaacggagaggttactgatctgaattgttgaagatcggaaaatgacagaatcgagtctggatctgcaggaatctggttgggaagaacttaggcgggaagctcgtaaaattgaaggagatctagacgttaagctctcttcttacgctaagctaggcgccaggtttactcaaggcgggtatgttgacactgggtctccaaccgttggatcggggagatcatggaagtctatggagatggaaattcaatcgttgcttgagaagttgttggatattaatgattccatgagtagatgtgctgcatctgctgcacccacaacatcggttactcaaaaactagcaaggcacagggatatacttcatgaatatacccaggagtttcgaagaataaaaggaaatataaactcgttgagagaacacgctgagcttctgagttctgtcagggatgacataagtgaatataaggcttctggtagtatgtcaccaggtgtgcaagtgttaagggagagagcttcaatccatggaagtatatcccatattgatgatgtgattggtcaagctcaagcgacaagagcagttcttggctctcaacgatctctgttttcagatgttcaagggaaagtaaaaaatctcggagacaaattcccagtgattcgtggcttacttggctcaattaaaaggaaacgttctcgggacacacttatcctctccgctgtcatcgctgcttgtacgttgtttctaatcatctactggctctcaaaataaacagaatgttcatacacctaagctataaaacgagtttgccttgacatccctagatcgatttttttacaagttttttcttgcttttgtgtttttgccattatgttgggttatatgtttgtaggacaatattacaccctgaatcatatcgtaaaagtaaaattcgaaacatatatttcacaacatcaaagatcc

SEQ ID NO: 44 - DNA, 1800 bp, Arabidopsis thaliana
tttttcttctaaagagataacatcactatacaatctcactctatccccaaatcttctccttctccaaaaaaatttcaaaccctagcttctcgatttctctcctctgctctccaattccatcttcccatggcgatttcggctccagccgcttgttcttcctcctctagaattctctgttcctactcctctccttctccttctctctgtcccgccatttccacctctggtaaactcaaaaccctaactctctcttcctccttcctcccttcttactcattaaccaccacctccgcttctcaatccactcgtcgctccttcaccgtccgcgccgctcgtggaaagttcgagaggaagaagcctcatgtcaacatcggaaccatcggtcatgttgaccatgggaaaactactttaaccgcagctctaaccatggctctcgcttccattggttccagcgtcgctaaaaagtacgacgagattgacgctgcgccggaggagagagctcgtggtatcacaatcaacactgctactgttgagtacgagactgagaatcgtcactacgctcacgttgattgtcctggtcacgctgattacgttaagaatatgattaccggagctgcacagatggacggagctatcctcgttgtttccggcgccgatggtcctatgcctcagactaaagagcatatccttttggctaagcaggttggtgttcctgatatggttgtgtttcttaacaaagaggatcaagtagatgatgcagagttgctagagctcgttgagcttgaggttcgtgagcttctctcgtcttatgaatttaacggtgatgatattccgattatctctggttctgctcttttagccgttgagactcttactgagaatcctaaggttaagagaggtgataacaaatgggtagataagatttatgaacttatggatgctgttgatgattacatccctatccctcagagacaaactgaattgccattcttgttagctgttgaggatgtgttctctatcactggacgtggtacggtggctacagggcgtgtcgagagaggtacggttaaggtaggagagactgtagatttagtgggtttgagggagactaggagttacactgtcactggggttgaaatgtttcagaagattcttgatgaggctttagctggtgacaatgtagggttgttgcttaggggtattcaaaaggctgatattcagagaggtatggttttagctaagccgggatcgattactccacataccaagtttgaagcaattatctatgtgttgaagaaagaggaaggtggaaggcattctccattctttgcagggtacaggcctcagttctacatgaggacgactgatgttacgggtaaagtgacgaagatcatgaacgacaaagatgaagagtcgaagatggttatgcccggtgatcgagtgaagattgttgttgagcttattgtgccggtggcttgtgaacaagggatgaggtttgctatcagagaaggaggaaagactgttggtgctggagttattgggacgatcctcgaatgattataaggttttagagagtttcatatagtgagcatctctacttgctttctttttgtttcactcttgattctcaaactctttgagtttttacctttttttatttatttttgtgccattttccataagaacttgaaatcaaaatgtcatatatttcttgattttctgatccttgttattcatctttgtctcgctccatatgattctgatgtggatttggtactcaacgaccaatcacttaatttg

SEQ ID NO: 45 - DNA, 1759 bp, Arabidopsis thaliana
accacagagaaccacaacatacaaaaaaagaaccctatagaactctgatttttttcttgttgtcaatagtcaatggctcacagtcacactaatggcgccatctctccttctttctccaaagacttatgcgaggagcgtgaaatccaaaagaattactggaaagagcattcagtgggattgagtgttgaagctatgatgcttgattccaaagcttctgacctcgacaaagaagaacgtcctgagatacttgcgtttcttccacctattgaagggacaacagtgctagagtttggtgctggaattggtcgttttactactgaattagctcagaaggccggccaggtcattgcggttgacttcattgaaagtgttatcaaaaagaatgagaacattaacggtcactacaagaacgtcaaatttctgtgcgctgatgtcacatcaccaaatatgaactttccaaatgagtctatggatctgatattctccaactggctgctaatgtatctctctgatcaagaggttgaagatttggcgaaaaagatgttacaatggacaaaggttggcgggtatattttctttcgggagtcttgtttccatcagtctggtgataacaagcggaagtacaacccaacacactaccgtgaacctaaattttacacaaagcttttcaaagaatgccatatgaatgacgaagatgggaattcgtatgaactctctttggttagctgtaaatgcattggagcttatgtgagaaacaaaaagaaccagaaccagatatgctggctttggcagaaagtcagttcggataatgataggggcttccaacgcttcttggacaatgtccagtataagtctagtggtatcttacgctatgagcgtgtctttggagaagggtttgttagcacagggggactcgagacaacaaaggaattcgtggatatgctggatctgaaacctggccaaaaagttctagacgttgggtgcggaataggaggaggggacttctacatggctgagaactttgacgtggatgttgtgggcattgatctatctgtaaacatgatctcttttgcgcttgaacacgcaataggactcaaatgctctgtagaattcgaagtagctgattgcaccaagaaggagtatcctgataacacctttgatgttatttatagcagagacaccattctacatatccaagacaagccagcattgttcagaagattctacaaatggttgaagccgggagggaaagttctcatcactgattactgcagaagccccaaaaccccatctccagactttgcaatctacatcaagaaacgaggttatgatcttcatgatgtacaagcatacggtcagatgctgagagatgctggtttcgaggaggtaatcgcggaggatagaaccgatcagttcatgaaagtcctgaaacgggaactggatgcagtggagaaggagaaggaagaattcatcagtgacttctcgaaagaggattacgaggatattataggcgggtggaagtcaaagctacttaggagctcaagtggtgagcagaagtggggtttgttcatcgccaagagaaactgattatggcatttactataagttggaaataaatttgggtatgtatgtagatcatcaaaacccagtaccctgctattatctctacaagctatatatatgtggctgtgaggttcctttaatgtctccattttacagcatatccagtttggtatttaatatatgtgatattttgaaa

SEQ ID NO: 46 - DNA, 1101 bp, Arabidopsis thaliana
atagagagtggcatatccgacggtttaggatctctgccttttctcaacttatagtatataccaaacactttctaagccatggacaacgaaggcataggtctttacccgcttcatcgttgcaaaaccattcacctggtgagacatgctcaagggattcataatgtggctggtgaaaaagatcacagtgcttactcttcggaggattactttgatgctcatcttacccctcttggttggcaacaggttgataatctaaggaaccatgttcgtgcagctcaactcttaaacaaggttgaacttgtcattgtttcccctatgcttagaactatacaaacagctgttggtgcttttggaggagaagaagatactaatggagcggatgcaacaccgttaatggtggctaatgctgggagcagcgatcgtcctgcgatttctagcttaaatagtcctcctttccttgctgttgagctttgcagggaaactatgggtgatcatccttgtgacaggcgaagaagcgtcactgagtacaaggctctctttcccgctattgatttctcaattattgaaaccgacaatgatgttctgtggaagccgagtccaagagagagccttgaagaagttgcagccagaggtgtagagttcatcaaatggatatggacaaggaaagagaaggagatcgcaattgtatctcacagtggcttcttgcacggtctcttgagttctttcgggaaggattgttgcgatgacctaaagaaagagttgtctatacatttgagcaactgtgagcttcgctcaatggttatcgtggatcgagggaacctggggactgactctgcagagaccacaaactatcctgggaaggttcctgaaggacttgataatcctagtggctaaatggctgaagagtaagagagagaattctgagatagtttttctttctaaaataaataaattacatgatgtttccattggactagaatctggcattttcagttatttgatgaacattagtgttggtatgtagccatgtaggttgactctgctgctacatgaatttattgtatgattgttattatccaaaatttagcggtagctttaata

SEQ ID NO: 47 - DNA, 1154 bp, Arabidopsis thaliana
ttttatctataactatcaagaagaagaaaacactcggctatatatatacgtacaacacataagaaaaacaaaccaatcacttcactctctctaatcaaaaagcttttaacctcagccgttaaatctttctccgatcatgccgaccagaaacatcgccattggtggagtccaagaagaggtctaccaccccaacgcacttagggcggcgctcgctgagtttatctcgactttgatcttcgtcttcgccggatcaggctccggaattgctttcaacaagatcactgacaatggagccaccactccttccggcctcgtcgccgctgccttagctcatgctttcggtctctttgtcgctgtctctgttggcgctaacatttccggtggccacgttaaccctgccgttaccttcggtgtcttactcggtggtaacatcactctcctccgtggtattctctactggattgctcagcttcttggctccgtcgccgcttgtttcctccttagctttgccaccggtggcgagccaatcccagcgttcggtctctctgccggagtcggatcattaaacgctctcgtcttcgagatcgtgatgaccttcgggctcgtctacaccgtctacgccacagccgttgaccccaagaacggtagtctcggaacaatcgcaccaatcgccataggtttcatcgttggagctaacatcctcgccggtggagctttcagcggagcttccatgaacccagccgttgctttcggaccagccgtcgtaagctggacgtggaccaaccactgggtttactgggctggtcctcttattggtggtggactcgccggaattatctacgactttgtcttcatcgatgaaaatgcccacgagcaattgcctaccaccgattactgaagacgtcaaattcaacgttgttaatctgatgaatttttcgtgatttgcttttttaatttgcatcgtaatgggtttctggccgttggatcatttttagatgaatctttgtctattgattgatcatttatgtgtctttgggtttgttgttggagttgtaatatctctggaaggcttttgtgcaattgtattgtacggtttaataactataattgagaaaaccagggaatgtgaattatgaaaatgaatttttttgtta

SEQ ID NO: 48 - DNA, 1232 bp, Arabidopsis thaliana
atcgaccgacacgtgtccgttgcgtcccaaagtaaagcttataacgtgaaggcatttgtatcgtctcttccgccaaaattggaaatggatatcgaagtttgagctaagaatccaatttagggttaactttgccggattctcaagcaatctccgagagagacagagaggtttcgatggcgaggaacgggattgggagttcaggagggaagaagaatggggctgggcagtttttcttagcgacgctgcttctttggcttgtctccgtcgtgtttgagattgctttcaatctccggacggagcttctctgggtgatttgcggtggatgcttctttcaattgatgaattgggttgttcgttcatggatttctcgtgaccctatatttgttaatacctctgtctcgcttttgcactcaatcatcacctccgcatcagtggttttcatacttctcaatcaatgcttagccaaaggtttagacgagatgtttgatcattctgagttggttggtgggacttggaaatgggcatatccagctttgtgtttctcatgcggctactttgcatatgaccagtgggatatgcttcagtaccggttatacagcggcttaataccttctattcttgttcaccatctagtcctccttgtttgcttcacattggcactataccgaaatgtaaccatcaactaccttattcttactctcatctgtgagatgcattcgatctttctacacgtgaggaagctaaggagaatggcaggaatccgagacagcaacacagcattggtgaaactggagtgggtattaaactggacagcctttgtgtttgcgagatgcattcctcacattctcatcactatcaagctgatcaaagacgcacacaagtttgggaaaggcgtggagttaccactcgctctgtctggtatggcaggaatgaacattcttaatgttggcctcgggttggatctgtttcatgctttcagaagagagagaagccacagaagaaaccaagagaacggcaaccttcacgaccatggagaataatagctaatttagaggcaatccattaccgaatctatggtttgttgttgtatgaatactacccactcatctcttgtttatatctgaggctttgctactaagttctaatagctttcagatttgtatgtatctctctataggaaaactacatgtaaatgttatttcttgatgattacagtcaacagactttttttc

SEQ ID NO: 49 - DNA, 877 bp, Oryza sativa
ccttcaccgcagaaaccctagagctcaccctagcgcgccgccgccgcagccatctccgccgccgctcgtcgggctctctccatctcccatccaggatgaagttcatttctgcctatctgatggcctatctggctggcaactccagccccactgcggaggatttgacaacgattctggagtcagttggttgtgaaatcgacaatgcaaagatggaactcctgttgtctcaagtgagtggcaaggacatcactgagctcatcgcttgtggcagggagaagtttgcttcagttccatctggtggtggtggtgtagctgttgctgctgctgctcctgctgccggtggtgctggtggtgctcctgcagctgaggcgaagaaagaagataaggtcgaagagaaggaagaaagtgatgatgacatgggcttcagtttgtttgactgagtgatgcggtcacctcttctatcatcaataccagactttgcgcaggaaactagagtgatgatgtttgggattttagcttttcttctttagttaagttgaaaacacttgaggaaagactatgcttcctactatgttttgatatgtagtaacgcagccataggttgctggttacttcactggtgaaccatgcttttgctatcaaaattcaatgcttaatggaggatgaattgtgctcggcagtagtttttagctgtgttcaattatgtgtccctatttgttcggtgttatcagctcccaatttgattcatttgagctacgttatctgtctatcgttcatcttccgaagttgttttcctttgattttctgttttagagattacgataagccagaagttacatcagtaataataaaaaactttggcaattttaaacgagaa

SEQ ID NO: 50 - DNA, 1402 bp, Oryza sativa
gcgcgtctcgccgagggaggggaagagggaacggagtctatcgtgcggtgcggttctccgctcgccacgacgacgacgagccccatgcctcctccgccccatcgcggcggcggcggcggccgcgacacgagcgcgttcttcgcggcgacgctggtgctgtgggcggtgtcggtggggttcgagatcggcgcgcgcgggcggcgggagctggcgcccgtggccgcagggtttgccttcttccaggccgccagcgccgccgtgcgcgccgccgtctcccgcgacccgctcttcgtcaacaccgccgtttcgctcctgcactcctcgctcacgtcggcctccgttatctttgttcttgtcaaccgatggcataataaggacctcaagaacatgtttgagcatgaagaattgtttggtggcagttgggttggagcatattctgctctgtgcttttcttgtggctattttgcttatgatcaattagatatgcttcgttaccgactgtacagtggacggattcctggaattctcatgcaccacctgattctgctcatttgctttacactagctctgtatcggaatgtgacgatcaactacctaattctaactcttgtatgcgagctgcactccgtatttttgcacataaggaaattgaggcgaatggctggatttcgggattacaacagaaaaattgtgaaactggaatgggtcctcaactggactacatttgtatcagcaagggtggcatgccacatactgattacatacaaactgatcattgatgcccacaagtttgatagtggaattgagcttccactagctctttttggcatggcaggaatgaatctgctcaacatatttttaggacttgatctattaaaagcttacacgctcgagagaaatcagcagacacatcaggactgagtgtgcctctactgatgtggtactccaaaagttttggcaagttgtagtcaaacaacaattaatatagatcagcagacagaggtatgtcaatgtgttattggcctctacgttcggtagaaactagtaatgatgtactatattatgtgttctgaactcattataagatctctaccagcaaatgattctttgctattgtgctactatttgtatattgcgtttcatttatcatcatatgcagacaacctggatacaacatcgttgctcatattacaggtagaaaacgaacaaaattaaatggcattgtgtgccatcccgttttgttttaaagcttcgcctaaatcctaatgtattttagtgtctcgctgtgattgaattgtttccactaactgttgcatcatttgcactcttgtagtacttcatgtacactcttctctttaaaacgagactgaaatatacactgatgtatcatatccttttctcc

SEQ ID NO: 51 - protein, 544 aa, Oryza sativa
MESEMADAAPAPAVAAAATAEPLAAVAEEGEEGGEAAVGSTLTMERVAAAKKFIENHYRSQMKNIQERKERRFRLERQLESSQVPREQQINLLKDLERKETEYMRLKRHKICVDDFELLTIIGRGAFGEVRLCREKTSSNIYAMKKLKKSDMVVRGQVEHVRAERNLLAEVASHCIVKLYYSFQDSEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSFSETTNGRRWRSQHEQLQHWQMNRRKLAFSTVGTPDYIAPEVLLKKGYGMECDWWSLGAIMYEMLVGYPPFYSDDPITTCRKIVHWRNHLKFPEDSKVSPEARDLICRLLCDVDHRIGSAGADQIKAHPWFRGVAWEKLYEMEAAFKPQVNDELDTQNFMKFEEMDNAPTRTGSGPSRKMMLNSKDLSFVGYTYKNFDAVKGLKHSDQQRNQSLIRPSIGSIFGPADMDPSREPNGRDKHMHTVSSGDPMIQ

SEQ ID NO: 52 - protein, 139 aa, Brassica napus
MTVVSLLVAFTVVALCLHSSTSEFLKFQLSTISAAPTFLPEAPSSFSASPPEAMSPDISPLFPTPGSSETSPSPSESFDIPTIPSSLSPPNPDAVSPDPLLDSSPVGSPLPASSSVSLVSSPLSLLLAFPMLMLAFCRF

SEQ ID NO: 53 - protein, 182 aa, Brassica napus
MRKLKNHEKKVLKKVNFLEWKREGGHRETLITGRYHMGGRDDYKKYSGLCRMVQKLTNVLKQMDATDPFRIQMTDMLLEKLYNMGVIPTRKSLALTDRLSVSSFCRRRLSTVLVHLKYAEHLTEAVTYIEQGHIRVGPDTITDPAFLVTRNMEDFITWVDSSKIKRKVLQYNDKLDDYDMLA

SEQ ID NO: 54 - protein, 328 aa, Brassica napus
MTSDALNIPSELESALRLRTVQYFITKRPWLDLYGVHVRPVAPFGSTSSKPQFDPALIHRSLPDELLFEVFARMLPYDLGRAACVCRKWRYTVRNPVFWRNACLKAWQTAGVIENYRILQSKYDGSWRKMWLLRSRVRTDGIYVSRNTYIRAGIAEWKITNPVHIVCYFRYIRFYPSGRFLYKNSSQKLKDVAKYMNFKSSKADGLYRGTYTLSMTDDKIEAAVLYPGTRPTVLRIRLRLRGTAIGANNRMDLLSLVTSGVNDEEGSSTEEDILGVVENWRDDETHNPDIPAVSHKRGMTPFVFVPFEEVEQSVLNLPPEKMDYFVTG

SEQ ID NO: 55 - protein, 202 aa, Brassica napus
MQVVSPLSPATRFVGKESFAELYGKLNADFSSKLKVGFTNEEEEKNRDDNKSWWNQDDDDDEREEGEEDEEFSFTSLNADNSPITADEAFEDGQIRPVYPLFNRNLLFEPEERDLRSPLKKLFVESEEAATTEREEESEPMGPYCSWSGRTVVEEASPETCRKSSSTGFSKLWRFKDLVSRSNSDGKDAFVFLNHGDKKKQS

SEQ ID NO: 56 - protein, 867 aa, Arabidopsis thaliana
MKVAVIGSGISGLGSAYVLANQGVKEVVLYEKEESLGGHAKTVRFDGVDLDLGFMVFNRVTYPNMIEFFENLGVEMEVSDMSFAVSLDNGKGCEWGSRNGVSGLFAQKKNVLNPYFWQMIREIVRFKEDVLNYIEKLEGNPDIDRKETLGEFLNTRGYSELFQQAYLVPICGSIWSCPSDGVLSFSAYSVLSFCCNHHLLQIFGRPQWLTVAGRSQTYVAKVRAELERLGCKIRTSCDVKSVSTSENGCVTVTSGDGSEEVFDRCILAMHAPDALRLLGEEVTFDESRVLGAFQYVYSDIYLHHDIDLMPRNKAAWSAWNFLGSTEKKVCVTYWLNILQNLGENSEPFFVTLNPDETPKKALLKWTTGHPVPSVAASIASQELHQIQGKRNIWFCGAYQGYGFHEDGLKAGMAAARGLLGKETALLNNPRHMVPSLTETGARLFVTRFLGQFISTGSVTILEEGGTMFTFGGKDSTCPLKSILKIHSPQFYWKVMTQADLGLADAYINGDFSFVDKESGLLNLIMILIANRDTKSNLTKKRGWWTPMFLTAGLASAKYFLKHVSRQNTLTQARRNISRHYDLSNELFGLFLDDTMTYSSAVFKSDDEDLRTAQMRKISLLIDKARIEKDHEVLEIGCGWGTLAIEVVRRTGCKYTGITLSIEQLKYAEEKVKEAGLQDRITFELRDYRQLSDAHKYDRIISCEMLEAVGHEFMEMFFSRCEAALAEDGLMVLQFISTPEERYNEYRLSSDFIKEYIFPGACVPSLAKVTSAMSSSSRLCIEHVENIGIHYYQTLRLWRKNFLERQKQIMALGFDDKFVRTWEYYFDYCAAGFKTRTLGDYQLVFSRPGNVAAFADSYRGFPSAYCVS

SEQ ID NO: 57 - protein, 437 aa, Arabidopsis thaliana
MSRLDDIPSSPGKFKMEKSSYLHRLRFQSSLTKFAFFSFFLLCLISLLFLRSPPSINPSSPSDPSRRSLRTNTYGGPAWEKRLRSSARIRTSTNNGITVLVTGAAGFVGTHVSAALKRRGDGVIGLDNFNDYYDPSLKRARRALLERSGIFIVEGDINDVELLRKLFKIVSFTHVMHLAAQAGVRYAMENPSSYVHSNIAGFVNLLEICKSVNPQPAIVWASSSSVYGLNTKVPFSEKDKTDQPASLYAATKKAGEEIAHTYNHIYGLSLTGLRFFTVYGPWGRPDMAYFFFTKDILKGKSISIFESANHGTVARDFTYIDDIVKGCLAALDTAEKSTGSGGKKRGPAQLRVFNLGNTSPVPVSDLVRILERQLKVKAKKNLIKMPRNGDVPFTHANISLAQRELGYKPTTDLQTGLKKFVRWYLSYYSGDKKAAAR

SEQ ID NO: 58 - protein, 114 aa, Arabidopsis thaliana
MVIPPAVRPPRLFDYLKPYVLKMHFTNKFVHAQVIHSPTATVACSASSQEKALRETMDITRDVAAASKIGKILGERLLMKDIPAVTIQMKKEQRYHGKVKAVIDSVREAGVKLL

SEQ ID NO: 59 - protein, 432 aa, Arabidopsis thaliana
MKLKWESISNLQQNTYLIKLVAATLITCLAFRFFVFRFGQFSPVQVSVTGNSNSQISPTSVILSDNEDQIPVDIEVEKCDLFTGKWIKDPLGPIYTNESCGIVVDAHQNCITNGRPDSGFLNWKWKPNDCSLPRFDSLRFLQLMRNKSWAIIGDSIARNHVESLLCMLSTVEKPVEVYHDENYRSKRWHFPSYNFTVSNIWSPFLVQADIFEDSNGVSSAAVQLHLDKLDNTWTDLFPSLDYAIISSGEWFLKTAVYHENANPVGCHGCPESSNMTDLGFDYAYNTSLRHVMDFIAKSKTKGMIFFRTSIPDHFEDGEWHNGGTCKKTEPVGEEAVEMKVLNKILRDVEINQFERVVTEMGQESENLKLLDFAGMLLTRPDGHPGPYREFRPFDKDKNATVQNDCLHWCLPGPIDHLNDVILEIIVNGRTGK

SEQ ID NO: 60 - protein, 306 aa, Arabidopsis thaliana
MAQLIRPIRQLSPQCNHHFRNLRYLFSKKLPNPPSSIPTLLLFSSFSTERSPPRRRIRPAPPEALKPTVIVAEEDGDNDGYESDSLRSRNQRKRDARRAVKWGMELASFSGDQVKQILKAASLGEEVYDALMLAKRLGSDVREGKRRHFNYIGKLLREVEPDLMDTLINATKQGDHSTLQTLISSAKDVADDVGDSYDDDTETESEDEEEGSDEYTAMAARWFDGLISQNVELTKEVYSLQSVDFDRQELRKLVRKVQLVHEQRKGTTEEKQKEVEAALVTAEKSLNQFLCSMAKQVHSEQTDLYL

SEQ ID NO: 61 - protein, 44 aa, Arabidopsis thaliana
MWLSHELLPRGLGRIEMVPTSIVEETKCFKCMYCCEFYRLMSLV

SEQ ID NO: 62 - protein, 333 aa, Arabidopsis thaliana
MVLLLVIVGLISYYVYKSITPPPPIPLPENVSEISPRIKLNDGRHLAYKELGFPKDKAKNKIIIVHGNGNSKDVDLYITQEMIDEFKIYFLFFDRAGYGESDPNPTRTLKTDTYDIEELADKLQVGPKFHVIGMSLGAYPVYGCLKYIPNRLSGASLVVPLVNFWWSRVPQNLLNAAMKKLPIGFQLTLRVAHYSPWLLYWWMTQKWFPNSRNPKDTMTERDLELAEKHTKHSYIKESALRQGGYVTTQQDIIAGYGNWEFDPTELKNPFSDSNKGSVHMWCALEDKQISRDVLLYICDKLPWIKLHEVPDGGHYIIHEKRHFEAIIKAACSD

SEQ ID NO: 63 - protein, 523 aa, Arabidopsis thaliana
MSMSEFGIVYAIHIITVQFGSVVSKVCECLLRKGPLSSRDISRLAESDINHNKVKDILYLLIQHNCVQAFSIEPPDGSESKAIVQYIVLFNNILHRVRYNKFSRIVNEELDSKCGAVLDGLLSNGRLTLGQFIERDRDSGNTIGSEAIRDSLQKLVAARFVERIPSPEPVLGNKEKEPAKRRGAKAAKILKEPETLEEQVVEAATPVDAIRFPLIFEEDSNSSLADDNSNITEGKRKQRDVDTSDSSSGVIWRPNFEEFIHRLRHKACVEIVKERRDEGCAIVLRAMLEVGRSQEKKVKTDNSAPMSVGSIYEEVIKTEAGRTMLQERVEACLDQLSATSSYLPAFVNEVNDSYIVDYKSIISVAQKDEIEAVVMRRYGKEAFRMFRYLSQEGRFVETDKIADAALTEKKDTPQFLLKMWKDGYLHMQKLAVTAPGMYTPFLLWKVNKLIVTTQMLDEMYHASLNLSLRLAHELEAEKELLLLPLDKLEGPLKERLKKVKAKRLLLSSTMFKLDDAIMLFHDF

SEQ ID NO: 64 - protein, 522 aa, Arabidopsis thaliana
MAAIPLKAPSLPGTRECSPFLNRFVTHQPVNFIRKFHPSLDEASFSRRGRTTVVRVLETEKSTKIEKPEPPVKLIALVGKGEVSPLKSTSWEEVMLHTARRLKWVDEGYEMLVFDDEIVSSNDQRAMNLTQELNQTDILVVVAVNNSESVNWIQTNSKNVKNMICFESSPNLMNRLGGTDVGSVNKDKEVTEVVKTVGDAWERRNSDDIRFCLLVIINAYIRPVPVLQNLRSKGFSTLSCMVKNCGPQILNCLLDPNCRKALQCLNQCSPVDQVCSYRCIASYEGPYFEAFSLCVLQKHNCLELDAKIPEKPYVPPMTSFRGKELCHDTAEDLFVGWLGELEWSWRVVAGQNPAYDQFPCQYQLFYRGKGKSSFWYEPVFQVRTLEEKLVWRRRRYSVKRGKIPATFRFSVLDNGVVSNEFWTIVDVSDDLSWGLFHYHGAARVAGQSYTGAVLVTPDGSYPAEKDKERLQSALEKCGIKEWELFAVDNCSCENPPLGIPQGSRLHSRISIIEEPDSEEKFN

SEQ ID NO: 65 - protein, 419 aa, Arabidopsis thaliana
MEEREGTNINNIPTSFGLKQHETPLPPPGYPPRSENPNLFPVGQSSTSSAAAAVKPSENVAPPFSLTMPVENSSSELKKKRGRPRKYNPDGSLAVTLSPMPISSSVPLTSEFGSRKRGRGRGRGRGRGRGRGQGQGSREPNNNNNDNNWLKNPQMFEFNNNTPTSGGGGPAEIVSPSFTPHVLTVNAGEDVTMKIMTFSQQGSRAICILSANGPISNVTLRQSMTSGGTLTYEGHFEILSLTGSFIPSESGGTRSRAGGMSVSLAGQDGRVFGGGLAGLFIAAGPVQVMVGSFIAGQEESQQQQQQIKKQRRERLGIPTTTQASNISFGGSAEDPKARYGLNKPVVIQPPPVSAPPVSFSHEPSTNTVHGYYANNTANHIKDLFSSLPGEDREEDEDDLEGEDDEEFGGHSESDTEVPS

SEQ ID NO: 66 - protein, 591 aa, Arabidopsis thaliana
MENPPDQTESKETLQQPITRRRTKGGLLTMPFIIANEGFEKVASYGLLQNMILYLMSDYRLGLVKGQTVLFMWVAATNFMPLVGAFLSDSYLGRFLTIVIASLSSLLGMVVLWLTAMLPQVKPSPCVATAGTNCSSATSSQLALLYTAFALISIGSGGIRPCSLAFGADQLDNKENPKNERVLESFFGWYYASSSVAVLIAFTVIVYIQDHLGWKIGFGIPAILMLLAGFLFVFASPLYVKRDVSKSLFTGLAQVVAAAYVKRNLTLPDHHDSRDCYYRLKDSELKAPSDKLRFLNKACAISNRDEDLGSDGLALNQWRLCTTDQVEKLKALVKVIPVWSTGIMMSINVSQNSFQLLQAKSMDRRLSSNSTFQIPAGSFGMFTIIALISWVVLYDRAILPLASKIRGRPVRVNVKIRMGLGLFISFLAMAVSATVEHYRRKTAISQGLANDANSTVSISAMWLVPQYVLHGLAEALTGIGQTEFFYTEFPKSMSSIAASLFGLGMAVANILASVILNAVKNSSKQGNVSWIEDNINKGHYDYYYWVLAILSFVNVIYYVVCSWSYGPTVDQVRNDKVNGMRKEEEEVIKLN

SEQ ID NO: 67 - protein, 250 aa, Arabidopsis thaliana
MDQSNSLLSWTYFSHGKTTEELRQTLVYTTMELEQTKLVAHEELRKRDEQLIHLEDVLTKTLKERDEALEKYNHLLLNNLLLQQKQQQNQNQKQELVTPPLSGASSIIEDEQVQPQQPQLNSNKSFSSSDTEESIMSPSVIDPVTMNQQIEVSGDEMLATLLPDKPLPEKGKLLQAVIKAGPLLQTLLLAGPLPQWRHPPPPLETSEIPPVTIPLPQFQNNGCGNSNKKRAFSISDETYSETKYQKVLLH

SEQ ID NO: 68 - protein, 491 aa, Arabidopsis thaliana
MAMRHLSRSRDVTKRSTKKYIEEPLYNRLFKDGGTEVKVRQQLNQFLKGTKHVFKWEVGDTIKKLRNRGLYYPALKLSEVMEERGMNKTVSDQAIHLDLVAKAREITAGENYFVDLPETSKTELTYGSLLNCYCKELLTEKAEGLLNKMKELNITPSSMSYNSLMTLYTKTGETEKVPAMIQELKAENVMPDSYTYNVWMRALAATNDISGVERVIEEMNRDGRVAPDWTTYSNMASIYVDAGLSQKAEKALQELEMKNTQRDFTAYQFLITLYGRLGKLTEVYRIWRSLRLAIPKTSNVAYLNMIQVLVKLNDLPGAETLFKEWQANCSTYDIRIVNVLIGAYAQEGLIQKANELKEKAPRRGGKLNAKTWEIFMDYYVKSGDMARALECMSKAVSIGKGDGGKWLPSPETVRALMSYFEQKKDVNGAENLLEILKNGTDNIGAEIFEPLIRTYAAAGKSHPAMRRRLKMENVEVNEATKKLLDEVSQDV

SEQ ID NO: 69 - protein, 301 aa, Arabidopsis thaliana
MNTNPVTNGFVKPVPTEEEQAKIEEVRKLLGPLPEKLSSFCSDDAVLRYLRARNWHVKKATKMLKETLKWRVQYKPEEICWEEVAGEAETGKIYRSSCVDKLGRPVLIMRPSVENSKSVKGQIRYLVYCMENAVQNLPPGEEQMVWMIDFHGYSLANVSLRTTKETAHVLQEHYPERLAFAVLYNPPKFFEPFWKVARPFLEPKTRNKVKFVYSDDPNTKVIMEENFDMEKMELAFGGNDDSGFNIEKHSERMKEDDKKRLASLEGIVSASLDSLSILSVSDGTASNSAHPSSHDVSEDEH

SEQ ID NO: 70 - protein, 266 aa, Arabidopsis thaliana
MDLEDWELVLPKNSFKDLDLDHDEDHHGAMVMDYFLCPSTKDPLPKTESPPRSKVVPKKILQVPIAWEAVLDQDNTKIPNNPDLEPDPHPDPDSKPTLSTDSVSSPRVSFKIMKDTEFADMKIDPPARITSPLPQIDDAASKPSDLEGGDDLRDKKEVVLEEEDEDGSGGERLNLWKAGLNGIGAICSFGVAAAAATVCVFFLGHNNIKICKNKNQMLRFQIYSDDNKRMKEVVNHATKLNEAIFGMKGVPVVRAQISFGGHYDGL

SEQ ID NO: 71 - protein, 250 aa, Arabidopsis thaliana
MLAIFHEAFAHPPEELNSPASEKCSKQPKLPEETLNDFLLRYPLNTFSMSFGQAAVLAYVRPSASFSIHQRLFCGFDDIYCLFFGSLNNLCQLNKQYGLTKTTNEAMFVIEAYRTLRDRGPYPADQVVKDLDGSFSFVVYDSKAGSVFTALGSDGGVKLYWGIAADGSVVISDDLDVIKEGCAKSFAPFPTGCMFHSEGGLMSFEHPMNKIKAMPRVDSEGVLCGANFKVDVYNRVNSIPRRGSEANWSL

SEQ ID NO: 72 - protein, 306 aa, Arabidopsis thaliana
MEPSSGTGPEKRPTVDLVKDRNGTDQILLQNPRGASVKISLHGGQVLSWKTDKGDELLFNSTKANLKPPHPVRGGIPICFPQFGTRGSLEQHGFARNKMWLVENNPPALPSFDSTGKAYVDLVLKSSDEDTMRIWPYSFEFHLRVSLALDGNLTLISRVRNINSKPFSFSIAYHTYFSISDISEVRLEGLETLDYLDNMHDRERFTEQGDALTFESEIDRVYLNSKDVVAIFDHERKRTFLIKKEGLPDVVVWNPWEKKARALTDLGDDEYRHMLCVDGAAIEKPITLKPGEEWTGKLHLSLVLST

SEQ ID NO: 73 - protein, 594 aa, Arabidopsis thaliana
MPEKGMIFPPVPSQLVILRPSPLLQWRLGALTALVCFLMLVVWSIDGCSIQSFVQPWRFNAYSVRISPSPSPFMSTKPNLVSEKPHRQNLTLMMAPRNLVPKKTNLTSNSTRVQFEWITAGSQKNFTANLMRGWLAPGGAPCREAKTVEISVPGVDGIDSVELTAGEIHEFKFQAIDESGKNVCIGGDYFETDISGENWKSRPPVKDFGNGTYSFSLQVHPEFAGDFNLTVILLFRHYQGLKFSTSRLGFDRKLRNVRLRFVKTPDVTLPELRSCKKSDFNRDAWSGRWTRLGKNDECQISNDGRYRCLAADFPCRKPWCDGAVGAIESNGWVYSSHCSFKLFSAEKAWDCLKGKWIFFWGDSNHVDSIRNLLNFVLGHPEIPAVPRRFDMKFSNPKNPSETVRITSIFNGHWNETKNYQGLDSLKDRDFRELLKKYFNEETNRVPDVMIVNSGLHDGIHWTSLRAFAKGAETAAAFWREVFDGVKSRGLQPPEVIFRNTIATGGYARMLAFNPSKMEAFNGVFLEKMRDAGLVTSVVDNFDMTYPWHYDNRCNDGVHYGRAPAKMRWRDGEIGHQYFVDLMLVHVLLNALCVR

SEQ ID NO: 74 - protein, 216 aa, Arabidopsis thaliana
MEMKRDIRVEEENMCTSLLTAVVVLSMACLKHFSSVSYLIEQWRSLVFLILNVVLLAVYFTSTRPNLGRSHDFKTRRGGRLRMMREKKNKIKKKKTRVVVEPACFDQGFLLVEPKEVIKKCVLVEETKRVCPKFEETVKDCLFHKKEIEYNGEEDEFEPGRLSNEELNERVEAFITTFRQHLVLDARRGRDRETDQKMRPKDSDSSFLVREVTCLV

SEQ ID NO: 75 - protein, 568 aa, Arabidopsis thaliana
MVESDKSSVEELKKRVRKRSRGKKNEQQKAEEKTHTVEENADETQKKSEKKVKKVRGKIEEEEEKVEAMEDGEDEKNIVIVGKGIMTNVTFDSLDLSEQTSIAIKEMGFQYMTQIQAGSIQPLLEGKDVLGAARTGSGKTLAFLIPAVELLFKERFSPRNGTGVIVICPTRELAIQTKNVAEELLKHHSQTVSMVIGGNNRRSEAQRIASGSNLVIATPGRLLDHLQNTKAFIYKHLKCLVIDEADRILEENFEEDMNKILKILPKTRQTALFSATQTSKVKDLARVSLTSPVHVDVDDGRRKVTNEGLEQGYCVVPSKQRLILLISFLKKNLNKKIMVFFSTCKSVQFHTEIMKISDVDVSDIHGGMDQNRRTKTFFDFMKAKKGILLCTDVAARGLDIPSVDWIIQYDPPDKPTEYIHRVGRTARGEGAKGKALLVLIPEELQFIRYLKAAKVPVKELEFNEKRLSNVQSALEKCVAKDYNLNKLAKDAYRAYLSAYNSHSLKDIFNVHRLDLLAVAESFCFSSPPKVNLNIESGAGKVRKARKQQGRNGFSPYSPYGKSTPTKEA

SEQ ID NO: 76 - protein, 460 aa, Arabidopsis thaliana
MQKRELGKSGGNSGGSSGPPAKRGRPFGSTSANSAAAAAAAAAADAMSPSALLGPSLLVHNSFVEQNNRRIVLALQSGLKSEVTWALNTLTLLSFKEKEDIRRDVMPLAKIAGLLDALLLIIDDWRDIALPKDLTRGTRVRTLGTNASVTGFGNEYDALASIQPPGSGIGSSAAEALGKKSTGKHQSSQWWMEEDGLFNLDDEGRSEKQMCAIAASNVIRNFSFMPDNEVVMAQHRHCLETVFQCIHDHMTEDEELVTNSLETIVNLAHLMDLRIFSSLKQSYININEKKAVQAVVGILNSSVKAWNCAAAELLGRLIINPDNEPFISPLIPQIHKRLIDLLSIQAVDAQAAAVGALYNLVEVNMDCRLKLASERWAVDRLLKVIKTPHPVPEVCRKAAMILENLVSEPQNRGLLLAYENAFAELLFQEGKYSDSFARILYELTARSNSRVASARGIWGM

SEQ ID NO: 77 - protein, 330 aa, Arabidopsis thaliana
MSLTELDDGLVRRMAMGAVFSDFGGKIHSVGFHRTDDLLVTSSEDDSLRLFDIANAKQLKITYHKKHGTDRVCFTHHPSSLICSSRYNLESTGESLRYLSMYDNRILRYFKGHKDRVVSLCMSPINDSFMSGSLDRSVRLWDLRVNACQGILHLRGRPAVAYDQQGLVFAIAMEGGAVKLFDSRCYDKGPFDTFLVGGDTAEVNDIKFSNDGKSMLLTTTNNNIYVLDAYRGEKKCGFSLEPSQGTPIEATFTPDGKYVLSGSGDGTLHAWNIENPSEVARWENNIGVVSCLKWAPRRAMFVAASTVLTFWIPNDGESPAPADPPTDQQQ

SEQ ID NO: 78 - protein, 510 aa, Arabidopsis thaliana
MDERDREIRASHGDSNAGNVVSQSIENTREEDSGSCEGFVEESKRLEPEQQKHGKYFFYDTPLSEETGVWIPVSVPPMLEPDHEEWSRGLSFNGGYFPEGDMGWDQIFDEDKELTMWDVIVDMLLAARGKASALSSGNLERCGINFLSGHLLEQAWQDMAHTLTEANFGNAREILETEPPKWLPDSAASACMLCSVRFHPIMCSRHHCRYCGGIFCRDCSKGKSLVPVKFRVSDPQRVCDVCFVRLESVQPYLMDQVSPAAQLPTHDLTDLSTLRSWVNFPWGQSMEYEIYKATNTLRGYITKVGSSRTERSIPDAILRQAKGLAVITVARVGVMVTYKIGTGLVVARRDDGSWSPPSAISSFGLGWGAQAGGEFIDFIIVLRTREAIQTFGSNTHLVVGAGLSAAVGVTGRAVEADIRAGSGGYAACYTYSCSKGAFVGCSLEGSIFTTRTSENSRFYGSQSLAASDILLGSLPRPPAAAALYRALGDLYQKMGSETVRSPAISPLSED

SEQ ID NO: 79 - protein, 407 aa, Arabidopsis thaliana
MVPSNNRCKWSSIFLFLLSVSVAVLVAVADDKSPAVEDGLVINGDFETSPSSGFPDDGVTDGPSDIPSWKSNGTVELINSGQKQGGMILIVPQGRHAVRLGNDAEISQDLTVEKGFVYSVTFSAARTCAQLESINVSVASVNADADDMLASRNVDLQTLYSVQGWDPYAWAFEAEDDHVRLVFKNPGMEDDPTCGPIIDDIAIKKLFTPDKPKDNAVINGDFEDGPWMFRNTSLGVLLPTNLDEEISSLPGWTVESNRAVRFVDSDHFSVPKGKRAVELLSGKEGIISQMVETKADKPYILSFSLGHAGDKCKEPLAIMAFAGDQAQNFHYMAQANSSFEKAGLNFTAKADRTRVAFYSVYYNTRTDDMSSLCGPVIDDVRVWFSGSKRIGAGFGFWVFVLLVVGLV

SEQ ID NO: 80 - protein, 420 aa, Arabidopsis thaliana
MKCFYFSKDKTQDDEAKTRKFGSATMARGGSGSEFNSDTSTATSITSSLHVLSETHSNNLKVFVLDDLKTATKNFSRSLMIGEGGFGGVFRGVIQNPQDSRKKIDIAVKQLSRRGLQGHKEWVTEVNVLGVVEHPNLVKLIGYCAEDDERGIQRLLVYEYVQNRSVQDHLSNRFIVTPLPWSTRLKIAQDTARGLAYLHQGMEFQIIFRDFKSSNILLDENWNAKLSDFGLARMGPSDGITHVSTAVVGTIGYAAPEYIQTGHLTAKSDVWSYGIFLYELITGRRPFDRNRPRNEQNILEWIRPHLSDIKKFKMIIDPRLEGNYYLKSALKLAAVANRCLMVKAKARPTMSQVSEMLERIVETSSDGAPSGLPLMKSLTPKDAFEASRRERVKRRFVELLIGENGCPNLPTWSHKLVTSI

SEQ ID NO: 81 - protein, 712 aa, Arabidopsis thaliana
MAEPSFARLFLLFFSFLLIFATYSWVFGPDSGFLFGTRVRKTLGSNRQVHVDHSLEKPHHPLDPLTVREINRVRTILSNHDPGFGSGSATIHSMALDEPEKSRVVQWKKGNKLLSRRAAVVAYWGGQTHEITVDLDSGRVVSDVINRTSGYPILTLNDVFAASQVPLKSLEFNRSIEARGVKFSDLACITPFAGWFGSEEEGRRVIRVQCFTLQGTTNYFMRPLEGLYVTVDLDKLEVIKIIDKGPIPIPKASGTEYRFGVQNKPVHMDRINPISMEQPDGPSFRVEDGHLVKWANWVFHVKADQRAGMIISQATVRDSETGEPRSVMYKGFPSELFVPYMDPEEGWYYKGYMDAGELGLGPTAMPLVPLNDCPRNSYYIDGVFASPDGKPIVQPNMICLFERYAGDISWRHSEILFANADIRESRPKVTLVARMATSVGNYDYIFDWEFQTDGLIRVTVAASGMLMVKGTPYDNVDDLGDREDDAGPLISENVIGVVHDHFITFHLDMDIDGPMNNSLVKVHLEKQRVPTGKSPRKSYLKVKKYIAKTEKDAQIKLSLYDPYEFHIVNPNRKSRVGNPAGYRIVPGGNAASLLDHDDPPQIRGAFTNNQIWVTPYNRSEQYAGGVLIYQSQGDDTLQVWSDRDRSIENKDIVLWYTLGFHHVPCQEDYPVMPTVAASFELKPANFFESNPILGSAPFFEKDLPVCRPFASS

SEQ ID NO: 82 - protein, 694 aa, Arabidopsis thaliana
MITVAPFVSLRFQFPLYIINRSTLFFRERTQYLVYNTCHILRTTAKTMPVVAEYAKSNRSSCRSCSNKIAVKSLRLGLISKGRGGVDMTRWHHFDCFPTDSESIASVDDIQGLSALEKEDQDALTKLVEQCGKVPAKKPDEKKGKAKKHIMGPKGLTKAATSSKVIADNAKSSRSSCNRCSQTIVSKDLRVGLVTEDSRGFDITRWHHLGCFPIDFHPIDSVEDIGGYSSLEKGDQMELKYLAEVNKKDKTLIDDVQKMDEGDDEAIADNELTEETKKGKHSPVAKLVEQPGEPAKEDEDEESKKPASDEISEQKTKDVKNSPDSSKVISEYAKSSRSTCKKCSQTIAAKELRLGLVTRNFRGFDMKQWHHLGCFPVDSDPIVSVEDIGGFSELQSGDQDALKELVQQCGKQTLVDKMDEDNDDTEAKIKLTEETNKRKHSEVGEMVEEDESLTKAKQQMAKTHKVNMSESTSQVEVEAEITLSASDVKDKYRDANLLPKWKAFETVIFLERDDGLNDSEKIAAFDFDGCLAKTSVKIVGADAWSLMYPSIPEKLQSLHDQGYKLVIFTNESNIDRWKNKRQAAVDSKIGRLNSFIERVKVPIQVFIACGVSSSGGKGGKDDLYRKPKAGMWQLMKKHFNSGIAIDMDKSFYVGDAAGRKMDHSDADIKFAQASGLKFFTPEEYFIPSSTSPGT

SEQ ID NO: 83 - protein, 312 aa, Arabidopsis thaliana
MQGACISESQPWYLHFVCFIGFLFLLRVLFIPLLKWFTTRFLLTPKRLKRYGSWAMVTGATEGIGRAFAHELAKHGLNLILVSRNLSKLESVSDDFQQEFPHIKIKIIPFDFSSEGGYGAIEEGIKGLEVGILINNVGITYPRAMFFHEVDQLTWTKILRVNLEATTWVTRSLIGPMLHRRRGAIVNISSGAAVVVPSHPLYAIYAATKAYVDALSRSLHVEYKQFGIDVQCQVPLYVSTRMVSEVAAIDKPSLFVPSPEVYAKAAVAQIGIGSRCSPFWAHSLQWFLVGLVPDNLVDTWRLSIGLRRRSLS

SEQ ID NO: 84 - protein, 170 aa, Arabidopsis thaliana
MAVVISIHRPYVTLTISKNRNPLKPHRQFNESCLRFDHLPRNTKNQLRCLSAKSTPSKPDPASPQDGEELESVGVKAALAMLRFYKREISPVLPRSCRYVPTCSEYSMEAYKKYGVLKGTVLTTWRLCRCNPLGGSGFDPPRWFGESGIKLREGDEEEEDNYDDEDQRKI

SEQ ID NO: 85 - protein, 239 aa, Arabidopsis thaliana
MADSPQRRRDSRSPSPRKERARSRSRSRSRSRSRPRLRSRSRSLPRPVSPSRSRGRSRSRSRGRSEVENPGTTLYVTGLSTRVTDKDLEAHFAKEGKVASCFLVMEPRTRVSRGFAFVTMSSLKDAERCIKYLNQSVLEGRYITVERSRRKRPRTPTPGHYLGLKSSRDSDREGRSSRGRHYDRDDYRDRRSPRRDYSPRDERRSRRDRSYSPHGRSPERRSERRSERSERRYEPRGSR

SEQ ID NO: 86 - protein, 292 aa, Arabidopsis thaliana
MGVMINHHFLAFIFGILGNVISFLVFLAPVPTFYRIYKRKSTESFQSLPYQVSLFSCMLWLYYALIKKDAFLLITINSFGCVVETLYIAMFFAYATREKRISAMKLFIAMNVAFFSLILMVTHFVVKTPPLQVSVLGWICVAISVSVFAAPLMIVARVIKTKSVEYMPFTLSFFLTISAVMWFAYGLFLNDICIAIPNVVGFVLGLLQMVLYLVYRNSNEKPEKINSSEQQLKSIVVMSPLGVSEVHPVVTESVDPLSEAVHHEDLSKVTKVEEPSIENGKCYVEATRPETV

SEQ ID NO: 87 - protein, 544 aa, Arabidopsis thaliana
MTMGDSDLRKPTNFGTGHLSRRRSWCCSFAVPPASPDTRSISSRNHIPAKSQQQRPKLVPCSPQSSKSALNIVNRIDPRRILSPGRVSPIDSDPTVTTMQETETTQEEEDDAVVVDSTPNLRSESFRAPKIEVTGSGLSEGYDARLSLKGRNGGGVLVLELSLEVLAANSDVFSGLIAEEKKCSSSSSSLGLKNTCRIEVCDVENLGVFRETVELMFEESNVIIKKFMTMGVYRAIDVLEVAAGIKFSRAVLSCLKYLEAVPWTEDEEEKLRRLLGIYSFDDDAVSEILARFNSNETENLQDSLSKKLVWSITSCSDVNPRNELKSLVKGLLCKSSVYEKEQPEINKEDIYRAGKCCVDSLAKLFEEGSSSSSSKKEKPLIESISREVENINWLLEIMIDREIAEEFVEIWGKQRRLVEMHERVSPMVRYEVSRVTGAIFIAMGKRRVQCGGEARAGLVEAWFKPMLVDFGWLQRCKKGLDMREVEEGMGQTLLTLPVKEQYQVFMEWFRWFSKHGTECPNLSKAFQIWWRRSFLRGVESSTCR

SEQ ID NO: 88 - protein, 305 aa, Arabidopsis thaliana
MASNYRFAIFLTLFFATAGFSAAALVEEQPLVMKYHNGVLLKGNITVNLVWYGKFTPIQRSVIVDFIHSLNSKDVASSAAVPSVASWWKTTEKYKGGSSTLVVGKQLLLENYPLGKSLKNPYLRALSTKLNGGLRSITVVLTAKDVTVERFCMSRCGTHGSSGSNPRRAANGAAYVWVGNSETQCPGYCAWPFHQPIYGPQTPPLVAPNGDVGVDGMIINLATLLANTVTNPFNNGYYQGPPTAPLEAVSACPGIFGSGSYPGYAGRVLVDKTTGSSYNARGLAGRKYLLPAMWDPQSSTCKTLV

SEQ ID NO: 89 - protein, 409 aa, Solanum lycopersicum
MAGMCCGVNIAETEATTPVEPSSESARRRRMEIHQFRFVPTDVAAATQEKNGRKRHKIDKVIDNNKRQKLESSVTISLAVTDERNENEVLDLSESGSQSVEIEPDLPKYGMTSVCGRRRDMEDAVSIHPLFCKENSENSSNLHFFGVYDGHGCSHVAMKCKDRMHEIVKNEVEKEETQWKEAMIQSFSLMDKEVVNYSTSVLPSSTSGSNCRCELQTPQCDAVGSTAVVAVVTPDKIIVSNCGDSRAVLCRNGVAIPLSVDHKPDRPDELNRIQEAGGRVIYWDGARVLGVLAMSRAIGDNYLKPYVISEPEVTITDRTNEDECLILASDGLWDVVSNETACGVARMCLQSRRPPSPAGSPGNDITVTGAGESSDKACSDASILLTKLALARHSSDNVSVVVVDLRKNL

SEQ ID NO: 90 - protein, 191 aa, Arabidopsis thaliana
MANKFTRQQISEFREQFSVYDKNGDGHITTEEFGAVMRSLGLNLTQAELQEEINDSDLDGDGTINFTEFLCAMAKDTYSEKDLKKDFRLFDIDKNGFISAAEMRYVRTILRWKQTDEEIDEIIKAADVDGDGQINYREFARLMMAKNQGHDTKYDTTGGTLERDLAAGVAKNIIAAPMTDFIKNLFEALFS

SEQ ID NO: 91 - protein, 525 aa, Arabidopsis thaliana
MTVMNHRHKQCHFLLLLLITVFSAALDGVSSETDVGGFDYGEALSKSLLYFEAQRSGRLPYNQRVTWRDHSGLTDGLEQGVDLVGGYHDAGDHVKFGLPMAFTVTMLSWSVIEYGDSLASTGELSHALEAIKWGTDYFIKAHTSPNVLWAEVGDGDTDHYCWQRPEDMTTSRRAFKIDENNPGSDIAGETAAAMAAASIVFRSTNPHYSHLLLHHAQQLFEFGDKYRGKYDESLKVVKSYYASVSGYMDELLWGATWLYRATDNEHYMSYVVDMAHQLGGLSWAMSEFSWDVKFAGVQLLASMLLKEEKHKQHSKVLQQYKSKADHYLCSILNKNINGTNVQRTPAGLLYVRQWNNMQYVSTASFLLTVYSDHLRKSNTDLECHEGTVTPDEMLGFAKSQIDYILGSNPMETSYLVGYGPKYPIRVHHRGASIASFKEHKGFIGCTQGYDNWYGRSEPNPSVLVGALVGGPDHQDDFDDRRGNYVQTEACTYNTAPLVGVFARLIELEEQKLEEEDVSLVATYKR

SEQ ID NO: 92 - protein, 216 aa, Arabidopsis thaliana
MASPLLPTSTTPDQLPGGDPQLLSSLRVLLSRVLATVRHASADARPWAELVDRSAFSRPPSLSEATSRVRKNFSYFRANYITLVAILLAASLLTHPFALFLLASLAASWLFLYFFRPADQPLVIGGRTFSDLETLGILCLSTVVVMFMTSVGSLLMSTLAVGIMGVAIHGAFRAPEDLFLEEQEAIGSGLFAFFNNNASNAAAAAIATSAMSRVRV

SEQ ID NO: 93 - protein, 239 aa, Arabidopsis thaliana
MTESSLDLQESGWEELRREARKIEGDLDVKLSSYAKLGARFTQGGYVDTGSPTVGSGRSWKSMEMEIQSLLEKLLDINDSMSRCAASAAPTTSVTQKLARHRDILHEYTQEFRRIKGNINSLREHAELLSSVRDDISEYKASGSMSPGVQVLRERASIHGSISHIDDVIGQAQATRAVLGSQRSLFSDVQGKVKNLGDKFPVIRGLLGSIKRKRSRDTLILSAVIAACTLFLIIYWLSK

SEQ ID NO: 94 - protein, 476 aa, Arabidopsis thaliana
MAISAPAACSSSSRILCSYSSPSPSLCPAISTSGKLKTLTLSSSFLPSYSLTTTSASQSTRRSFTVRAARGKFERKKPHVNIGTIGHVDHGKTTLTAALTMALASIGSSVAKKYDEIDAAPEERARGITINTATVEYETENRHYAHVDCPGHADYVKNMITGAAQMDGAILVVSGADGPMPQTKEHILLAKQVGVPDMVVFLNKEDQVDDAELLELVELEVRELLSSYEFNGDDIPIISGSALLAVETLTENPKVKRGDNKWVDKIYELMDAVDDYIPIPQRQTELPFLLAVEDVFSITGRGTVATGRVERGTVKVGETVDLVGLRETRSYTVTGVEMFQKILDEALAGDNVGLLLRGIQKADIQRGMVLAKPGSITPHTKFEAIIYVLKKEEGGRHSPFFAGYRPQFYMRTTDVTGKVTKIMNDKDEESKMVMPGDRVKIVVELIVPVACEQGMRFAIREGGKTVGAGVIGTILE

SEQ ID NO: 95 - protein, 504 aa, Arabidopsis thaliana
MAHSHTNGAISPSFSKDLCEEREIQKNYWKEHSVGLSVEAMMLDSKASDLDKEERPEILAFLPPIEGTTVLEFGAGIGRFTTELAQKAGQVIAVDFIESVIKKNENINGHYKNVKFLCADVTSPNMNFPNESMDLIFSNWLLMYLSDQEVEDLAKKMLQWTKVGGYIFFRESCFHQSGDNKRKYNPTHYREPKFYTKLFKECHMNDEDGNSYELSLVSCKCIGAYVRNKKNQNQICWLWQKVSSDNDRGFQRFLDNVQYKSSGILRYERVFGEGFVSTGGLETTKEFVDMLDLKPGQKVLDVGCGIGGGDFYMAENFDVDVVGIDLSVNMISFALEHAIGLKCSVEFEVADCTKKEYPDNTFDVIYSRDTILHIQDKPALFRRFYKWLKPGGKVLITDYCRSPKTPSPDFAIYIKKRGYDLHDVQAYGQMLRDAGFEEVIAEDRTDQFMKVLKRELDAVEKEKEEFISDFSKEDYEDIIGGWKSKLLRSSSGEQKWGLFIAKRN

SEQ ID NO: 96 - protein, 271 aa, Arabidopsis thaliana
MDNEGIGLYPLHRCKTIHLVRHAQGIHNVAGEKDHSAYSSEDYFDAHLTPLGWQQVDNLRNHVRAAQLLNKVELVIVSPMLRTIQTAVGAFGGEEDTNGADATPLMVANAGSSDRPAISSLNSPPFLAVELCRETMGDHPCDRRRSVTEYKALFPAIDFSIIETDNDVLWKPSPRESLEEVAARGVEFIKWIWTRKEKEIAIVSHSGFLHGLLSSFGKDCCDDLKKELSIHLSNCELRSMVIVDRGNLGTDSAETTNYPGKVPEGLDNPSG

SEQ ID NO: 97 - protein, 253 aa, Arabidopsis thaliana
MPTRNIAIGGVQEEVYHPNALRAALAEFISTLIFVFAGSGSGIAFNKITDNGATTPSGLVAAALAHAFGLFVAVSVGANISGGHVNPAVTFGVLLGGNITLLRGILYWIAQLLGSVAACFLLSFATGGEPIPAFGLSAGVGSLNALVFEIVMTFGLVYTVYATAVDPKNGSLGTIAPIAIGFIVGANILAGGAFSGASMNPAVAFGPAVVSWTWTNHWVYWAGPLIGGGLAGIIYDFVFIDENAHEQLPTTDY

SEQ ID NO: 98 - protein, 288 aa, Arabidopsis thaliana
MARNGIGSSGGKKNGAGQFFLATLLLWLVSVVFEIAFNLRTELLWVICGGCFFQLMNWVVRSWISRDPIFVNTSVSLLHSIITSASVVFILLNQCLAKGLDEMFDHSELVGGTWKWAYPALCFSCGYFAYDQWDMLQYRLYSGLIPSILVHHLVLLVCFTLALYRNVTINYLILTLICEMHSIFLHVRKLRRMAGIRDSNTALVKLEWVLNWTAFVFARCIPHILITIKLIKDAHKFGKGVELPLALSGMAGMNILNVGLGLDLFHAFRRERSHRRNQENGNLHDHGE

SEQ ID NO: 99 - protein, 114 aa, Oryza sativa
MKFISAYLMAYLAGNSSPTAEDLTTILESVGCEIDNAKMELLLSQVSGKDITELIACGREKFASVPSGGGGVAVAAAAPAAGGAGGAPAAEAKKEDKVEEKEESDDDMGFSLFD

SEQ ID NO: 100 - protein, 278 aa, Oryza sativa
MPPPPHRGGGGGRDTSAFFAATLVLWAVSVGFEIGARGRRELAPVAAGFAFFQAASAAVRAAVSRDPLFVNTAVSLLHSSLTSASVIFVLVNRWHNKDLKNMFEHEELFGGSWVGAYSALCFSCGYFAYDQLDMLRYRLYSGRIPGILMHHLILLICFTLALYRNVTINYLILTLVCELHSVFLHIRKLRRMAGFRDYNRKIVKLEWVLNWTTFVSARVACHILITYKLIIDAHKFDSGIELPLALFGMAGMNLLNIFLGLDLLKAYTLERNQQTHQD

SEQ ID NO: 101 - DNA, 2105 bp, Brachypodium distachyon
gggatggagaacgagacgtcggacgcgccggcggccgcggtcgtcgccgagcagctccccgcggtggcggaggagggggacggggaggcggaggcggtggggtccaccctcaccatggagcgcgtcgccgccgcgaagaagttcatcgagaaccactaccgctcgcacatgaagaacatccaggagcgcagggagaggcgtgttagattggagagacagctagctacttctgaagttcccagggagcagcaaatcaatttaattaaagacctggagagaaaggaaactgagtacatgcgacttaaaaggcacaaaatttgtgtggatgactttgagctgctaaccattattgggagaggcgcttttggagaggtccgactgtgtcgtgagaagacctctggcaatatttatgcaatgaaaaaactaaagaaatctgatatggttatcaggggccaagtggaacatgttagagctgaaagaaacttgttggctgaagttgctagtcactgcattgtgaagctttactattcttttcaagatgcggagtacctttaccttattatggagtacctccctggtggtgatatcatgacccttctcatgagagaagataccttaactgaacacgtggctcgattctacattgctgagaccatccttgccattgaatccattcataagcacaactacatccacagagatattaagcctgataatctgcttcttgataagaatggtcacatgaagctgtcagattttgggctgtgcaagccaattgattgttctaagctctcaaccttgaatgaagatgaacccatgggtgatgacaacctgaaggaatcaatggatgtcgatcgttctctctctgaaactacaaacggtagaaggtggagaagtcaacatgaacagcttcagcactggcagatgaacagaagaaagctggcattctcaactgttgggacgccagactatattgctccggaagttctgctaaagaagggatatggaatggaatgcgattggtggtctttgggtgcaatcatgtatgagatgcttgttgggtatccaccattttattctgatgatccaataaccacatgcagaaagattgttcactggagaaaccatgtgaaatttcccgaggattcaaggctgtctcctgaagcaagagatctcatttgccggttattgtgtgatgttgaacacaggattggtggtgcaggggcagatcaaataaaggcccatccttggttccatggggttgcatgggataaactttatgaaatggaagcagcatttaagcctcaagtaaatgatgaattggatacacagaatttcatgaagtttgacgagatggataatcctccagcaagaacaggttctgggcaatcaagaaagatgaagctgaattcgaaggatctcagctttgtgggttatacatacaaaaacttcgatgctgtgaaaggattaaagcatgcagatatgcaaaggagctcatccttgaccaggccctcccttggttccatatttggtgaggcgcctagagagccaaacgggaaggacacacacatgcatacagattcttctgaggatccgatgagtccataacctttgtggttctgtttgttcctgcggaatttctgaactaaattagcatgcaaacgactcaatgaggctccatccggatgacctgcttgtttttagccaggtttctgccctgttaaatcgttagcgagcattttgtagaaatccaacaaagtgtctagctgtaaattagtatgctaaggacttgacaaatagcccatgtactgggaggctcatcgtgtttgttgtagcgtgttccgaccaagtggagatgcgcatgtttgggagggctggctgcccaggttggcagaacaaattgctgccttctcttgtggcagttcctggtccgctgatatttgatcatggaaacaaaataaggtggttactgcggcaggctaagcattattgttggtgtttgacacatatgtaccagaagatttccattcaggggcttgacccttcgtctatggtctccccttacaaaaatgcctaattttgtttaatgtactattcgcctgtta

SEQ ID NO: 102 - DNA, 2344 bp, Zea mays
acatcatcgccccccttccccgcggccccaccaaatagagaggcccagacaccgaggggaaaaaggagagagagtacacaggtgacagccgctgcaccgagggcacagagggacagctagacagggactgccagcggcgtaggcggtgtgggggatggagcgcgagatggcggacgcgcccgccgcggcgatccccgccgccgagccgctcgcggcggtggcggaggaaggggagggggaggcggccgccgaggcagtggggtccaccctcaccatggagcgcgtcgccgccgcgaagaagttcatcgagagccactaccgctcgcagatgaagaacatccaagagcgcaaggagaggcgctttagattggagagacagctagcttcttctcaagttcccaaggaacaacaaatcaatttaatgaaagatcttgagaggaaggaaactgaatacatgcgacttaaaaggcacaaaatttgtgttgatgattttgagctgctcactattattgggagaggtgcttttggagaggttcgattgtgtcgagagaggacctcaggcaacatttatgcaatgaaaaaactcaagaagtctgatatggttgtcaggggccaagtggaacatgttagagctgaaagaaacttgttggccgaagttgctagtcatcactgcattgtgaagctttactattctttccaagacactgagtatctttaccttattatggagtacctccctggtggtgatatcatgacccttctcatgagagaggatacattgactgaacatgcggcacgattctatgttgctgagactattcttgctatcgaatctatccataaacataactacatccacagagatattaagcctgataatttgcttctagataagaatggtcacatgaagctgtcagattttgggctgtgtaagccaattgattgttcaaagctctcaactttgaatgaagatgaacccatgagtgatgacaacttgagggaatcaatggatattgatagttctttgtctgatacagcaaatggtcgaagatggagaagtcaacacgaacagcttcagcattggcagatgaacaggagaaaactggcattctcaactgttggaacaccggattatattgctccagaggttcttctaaagaagggatatggaatggaatgcgattggtggtctctgggcgcgatcatgtatgagatgctaattgggtatccaccattttatgctgatgatccaataactacatgcagaaagattgtgcactggagaaaccatttgaagtttcctgaggatgcaaagttgtcaaatgaagcaagagatctcattagccgattattatgtgatgttgaccacaggatcggcagtgcaggggcagatcaaataaaggcacatccttggttccgaggagttgcatgggataaactttatgaaatggaagcagcatttaagcctcaagtaaatgatgaactggacacacagaatttcatgaaattcgaggaattggaaaatcctccagccaaaacaggctctggaccttcaaggaagacgatgctgaactccaaagatctgagctttgtggggtatacgtacaaaaacttcgatgcggtgaaagcaataaaaatttcagatctgcaaaggaattcatctctaacaaggccttccattggttcaatattcggtccaccaggcatggattctcccatggaaccaaacgggaggggcacacatatgcacacagtttcatctggtgatccaatgattccctaacctgcagtgctgtttgtcctcggcaaatttctgaactaaatcagcatgcaaacgcctggatgatgtggctccagctggataacctgctcatttttagccaggtttctgctttctcaatcgtgggcaagcggtttgtagaaatccaccagagtttctagttgtaaaatagtattccacggactttaacaaaggtcccatgtactaagggctcatcatcagacaccgggacagtttttttctggagaaattgcaccttgcggctggctgcccaggttggtagagcaaattgcggccttctcttgtggcagttcccggtccgctaacatttgatcagggaagggaaataagatggtgttgttgcggcaggaattctcatgggggggagttagtgttgttgtttgatatgtatcaggaattttcacatttgtagtagggtttctgttagcatattttagaaacatcctttttgcagagttgctatttctcattgatgtatggaaaacaacataatttggagatcgaagctcgatctaacttttatgctgcatatctgatctagat

SEQ ID NO: 103 - DNA, 2383 bp, Zea mays
cccgtaagagtgaggcccagaaatcgaggggcaaaaaggagagggagagaccgaatacaggctacagccgcttctgttctgtgaggggaaaaaagagaaagaagagagagagagagaggggctggccggctgagggagtgccaggccagctgtggggtgtgtgtgtgcctgtgtgggggaactgctggggatggagagcgagatggcggacgcgcccgccgcggcgatccccgccgccgccgccgaaccgctcgcggcggtggcggaggaaggggaaggggaagcggagggggaggcgcccgccgaggcggcggtggggtccaccctcaccatggagcgcgtcgccgccgcgaagaagttcatcgagaaccactaccgttcgcagatgaagaccatccaggagcgcaaggagaggcgctttaaattggagagacagctagcttcttctcaagttcccaaggagcagcaaatcgatttaataaaagatcttgagaggaaggaaactgaatacatgcgacttaaaaggcacaaaatttgtgtggatgactttgagctgctcactattattgggagaggagcttttggagaggttcgattgtgtcgagagaagacctccggcaacatttatgcaatgaaaaaactcaagaagtctgatatggttgtcaggggccaagtggaacatgttagagccgaaagaaacttgttggcggaagttgctagtcactgcattgtgaagctttactattctttccaagacaccgagtatctttacctaattatggagtacctccctggtggtgatatcatgacccttctcatgagagaggataccttgactgaacatgtagcgcgattctacattgctgagacaattcttgctatccaatccatccataaacataactacatccacagagatattaagcctgataatttgcttctagataaaaatggtcacatgaagctgtcagattttgggctgtgcaagccaattgactgttcaaagctctcaacgttgaatgaagatgaacccatgggtgatgacaacatgagggaatcaatggatattgatagttctttgtccaatacagcaaatggtagaagatggagaagtcaacacgaacagcttcagcactggcagatgaacagaagaaaactggcattctcaactgtcgggacaccggattatattgctccagaggttctgctgaagaagggatatggaatggaatgtgattggtggtctctaggcgcgatcatgtatgagatgctagttgggtatccaccattttatgccgatgatccaataactacatgccgaaagattgtgcactggagaaaccatttgaagtttcctgaggatgcaaagttgtcaaatgaagcaagagatctcatttgccggttattatgtgatgttgaccacaggattggcagtgcaggggcagatcaaataaaggcacatccttggttccaaggagttgcatgggataaactttatgaaatggaagcagcatttaagcctcaagtaaatgatgagctggatacacagaatttcatgaaatttgaggaactggaaaatcctccagccaaaacaggctctgggccttcaagaaagatgatgctgaactccaaagatctgagctttgtggggtatacatacaaaaactttgatgcagtgaaagcaataaaaatttcagatctgcaaaggaattcatctctaacaaggccttccattggttcgatattcggtccatcaggcatggattctcccatggaaccaaacggaagggacacacacatgcacacagtttcatctggtgacccaatgattccctaaccttcagtgccgtctgtcctcagcaaatttccgaactaaatcagcgtgcaaacgccagggtgatgtggctccagctggacaacatgcttatttttagccaggtctctgctctctttatcgtgggcaagcggtttgtagaaatccaccaaagtttctagttgtaaaatagtatgccacagacttcaacaaaggtcccatgcattattggctcatcagacatgggggcagtttttttttggagaaattgcaccttgcggctggctgcccaggttggcagagcaaattgcggccttctcttgtggcagttcccggtctgcaggaaagggaaatacgacggtgttgttgcagcaggaattctcatggttagtgtcgttgttggtgtttgatatgtatcaggaattttcacatttgaagtagggtttctgttagcagagttgtagctattgacaagcaacatccttttacggagttgctttttttcgttgatgtatggaaaacgagacattgtagaaatcgaagttcgatctagccttgtatgctgcttat

SEQ ID NO: 104 - DNA, 2458 bp, Sorghum bicolor
ggcccagacaccgagggggaaaaaggagaacagccgctgagagagaaagagagagggacagctagagagagagagagagagggactgccagcggtgcagggggtggtggtgtggggtgtggtggtggtggtggggatggagagcgagatggcggacgcgccggccgcggcggcgatccccgccgctgagccgctcgcggcggtggcggaggaaggggaaggggacgcggagaagggggcgggggcgggggcggccgaggcggtggggtccaccctcaccatggagcgcgtcgccgccgcgaagaagttcatcgagaaccactaccgctcgcagatgaagaacatccaggagcgcaaggagagattgccttttaccctgaggtcatgagtttatgacctttatttgaagagggtgcatcttttattcacatcttatgacttacaaaatttaatgcattgcaggcgctttagattggagagacagctagcttcttctcaagttcccaaggagcagcaaatcaatttaatgaaagatcttgagaggaaggaaactgaatacatacgacttaaaaggcacaaaatttgtgtggatgactttgagctgctcacgattattggaagaggtgcttttggagaggttcgattgtgtcgagagaagacctctggcaacatttatgcaatgaaaaagctcaagaagtctgatatggttgtcaggggccaagtggaacatgttagagctgaaagaaacttgttggccgaagttgctagtcactgcattgtgaagctttactattctttccaagacactgaatacctttaccttattatggagtaccttcccggtggtgatatcatgacccttctcatgagagaggataccttgactgaacatgtggcgcggttctacattgctgagacaattcttgctatcgaatccatccataaacataactacatccacagagatattaagcctgataatttgcttctagataagaatggtcacatgaagctgtcagattttgggctgtgcaagccaattgattgttcgaagctctcaactttgaatgaagatgaacccatgggagatgacaacttgagggaatcaatggatattgatagttccttgtctgatacagcaaatggtagaagatggagaagtcaacacgaacagcttcaacactggcagatgaacaggagaaaactggcattctcaactgttgggacaccagattatattgctccagaggttctgctaaagaagggatatggaatggaatgcgattggtggtctctgggcgcgatcatgtatgagatgctagttgggtatccaccattttacgccgatgatccaataactacatgccgaaagattgtgcactggagaaaccatttgaagtttcctgaggatgcaaagttgtcaaatgaagcaagagatctcatttgccggttattatgtgatgttgaccacaggattggcagtgcaggggcagatcaaataaaggcacatccttggttccgaggagttgcatgggataaactttatgaaatggaagcagcatttaagcctcaagtaaatgatgaactggatacacagaatttcatgaaatttgaggaattggaaaatcctccggccaaaacaggctctgggccttcaagaaagatgatgctaaactccaaagatctgagctttgtggggtatacatacaaaaactttgatgcagtgaaagctataaaaatttcagatctgcaaaggaattcatctctaacaaggccttccattggttcgatattcggtccaccaggcatggattctcccatggaaccaaacgggagggacacacatatgcacacagtttcatctggtgatccaatgattccctaacctgcagtgctgtttgacctcagcaaatttccgaactaaatcagcatgcacgcctggatgatgtggctccagctggacaacctgctcatttttagccaggtttctgcttttcttaatcgtgggcaagcgatctgtagaaatccaccaaagcttctagttgtacaatagtatgccaccgactttaacaaaggtcccatgtactaagggctcatcagacatgggggcaggtttttttggagagattgcaccttgcggctggctgcccaggttggcagagcaaattgcggccttctcttgtggcagttcccggtccgctaacatttgatcatgggagggaaataagatggtgttgttgcggcaggaattctcatgggtgagttagtggtgttgttggtgtttgatatgtatcaggaatttttcccatttgaagtagggttttctgttagagttgtagctatttacaaggaacatacttttacagcaatatttctcattgatgtatggaaaacgcgtccttgttcgtttgagcttatcagccgaatctactagccatttaacagtgtttttcttttac

SEQ ID NO: 105 - DNA, 2088 bp, Saccharum officinarum
gcgagatggcggacgcgcccgccgaggctgtggggtccaccctcaccatggagcgcgtcgccgccgcgaagaagttcatcgagaaccactaccgctcgcagatgaagaacatccaggagcgcaaggagaggcgctttagattggagagacagctagcttcttctcaagttcccaaggagcagcaaatcaatttaatgaaagatcttgagaggaaggaaactgaatacatgcgacttaaaaggcacaaaatttgtgtggatgactttgagctgctcactattattggaagaggtgcttttggagaggttcgattgtgtcgagagaagacctctggcaacatttatgcaatgaaaaaactcaagaagtctgatatggttgtcaggggccaagtggaacatgttagagctgaawkaaacttgttggccgaagttgctagtcactgcattgtgaagctttactattctttccaagacaccgagtacctttaccttattatggagtacctccctggtggtgatatcatgacccttctcatgagagaggataccttgactgaacatgtggcgcgattctacattgctgagacaattcttgctatcgaatccatccataaacataactacatccacagagatattaagcctgataatttgcttctagataagaatggtcacatgaagctgtccgattttgggctgtgcaagccaattgattgttcgaagctctcaactttgaatgaagatgaacccatgggtgatgacaacttgagggaatcaatggatattgatagttccttgtccgatacagcaaatggtagaagatggagaagtcaacacgaacagcttcaacactggcagatgaacaggagaaaactggcattctcaactgttgggacaccagattatattgctccagaggttctgctaaagaagggatatggaatggaatgcgattggtggtctctgggcgcaatcatgtatgagatgctagttgggtatccaccattttatgccgatgatccaataactacatgccgaaagattgtgcactggagaaaccatttgaagkttcctgaggatgcaaagttgtcaaatgaagcaagagatctcatttgccggttattatgtgatgttgaccacaggattggcagtgcaggggcagatcaaataaaggcacatccttggttccgaggagttgcatgggataaactttatgaaatggaagcagcatttaagcctcaagtaaatgatgaactggatacacagaatttcatgaaatttgaggaattggaaaaccctccaaccaaaacaggctccgggccttcaagaaagacgatgctaaactccaaagatctgagctttgtggggtatacatacaaaaactttgatgcagtgaaagcaataaaaatttcagatctgcaaaggaattcatctctaacaaggccttccattggttcgatattcggtccaccaggcatggattctcccatggaaccaaacgggagggacacacatatgcacactgtttcatctggtgacccaatgattccctaacctgcagtgctgtttgtcctcagcaaattttcgaactaaatcagcgtgcaaacgcctggatgacgtggctccagctggacaacctgctcatttttagccaggtttctgctttcgaaatcgtgggcaaggggtttgtagagatgcaccaaagtttctagttgtaaaatagtattgccacggactttaacaaaggtcccatgtactaagggctcatcagacacgggggcaggttttttttggagaaattgcaccttgcggctggcttcccaggttggcagagcaaattgcggccttctcttgtggcagttcccggtccgcwaacatttgatcatgggagggaaataagatggtgttgttgcggcaggaattctcatgggtgagtagtgttgttggtgtttgatatgtatcaggaattttttcccatttgaagtagggtttctgttagcagagctgtagctatttacaaggaacatacttttacagagttgctatttctcattgataacgacatattttggagatcgaagttcgatct

SEQ ID NO: 106 - DNA, 2069 bp, Panicum virgatum
gggacagctagggagactgccagaggtgcaggggcggtgggtgggcgaggcgatggagagcgagatggcggacgcgccggcggcgatccccgcccccgccgccgagccgctcgcggcggtggcggaggaaggggaaggggagggggccgaggcggtggggtccaccctcaccatggagcgtgtcgccgccgcgaagaagttcatcgagaaccactaccgctcgcagatgaagaacatccaggagcgcaaggagaggcgctttaaattggagaggcagctcgcttcttctcaagttcccaaggagcagcaaatcaatttaataaaagatctagagaggaaggaaactgaatacatgcgactaaagaggcacaaaatttgtgtggatgactttgagctgctcactatcattgggagaggtgcttttggagaggttcgactttgccgagagaagacttctggcaacatttatgcaatgaaaaaactcaagaagtctgatatggttgtcaggggccaagttgaacatgttagagccgaaagaaacttgctggctgaagtggctagtcactgcattgtgaagctttactactctttccaagacgctgagtacctttaccttattatggattacctccctggtggtgatattatgacccttctcatgagagaggataccttgactgaacatgtggcgcgattctatatcgcagaaacaattcttgctattgaatccatccataagcataactacatccacagagatattaagcctgacaacctgcttctagataagaatggtcacatgaagttgtcagattttgggctgtgcaagccaattgactgttctaagctctcaaccttgaatgaagatgaacccatgggtgatgacaatctaagggaatcaatggatgttgacagttctctgtctgacacagcaaatggtagaagatggagaagtcaacatgaacaacttcagcactggcagatgaacaggagaaaattggcattctcaactgttgggacaccagactatattgctccagaggttctgctaaagaagggatatggaatggaatgcgactggtggtccttgggagctatcatgtatgagatgcttgttgggtatccaccattttatgccgatgatccaataactacatgccgaaagattgtgcactggagaaaccatttgaagtttccagaggatgcaaggttgtcaaatgaagcaagagatctcatttgccggttattatgtgatgttgaccacaggattggcagtgcaggtgcagatcaaataaaggcgcatccttggttccgaggagttgcatgggataaactttatgaaatggaagcagcatttaagcctcaagtaaatgatgaattggatacacagaatttcatgaaatttgaggaattggaaaatcctccagctagaacaggctctgggccctcaagaaagatgatgctaaactccaaagatctgagctttgtggggtatacatacaaaaactttgatgccgttaaagcaataaaaatttcagatctgcaaaggaattcatctctaacaaggccctccattggttcgatattcggtccaccaggcatggattctcctatggaagcaaacggaagggacacacatatgcacacaatttcatctgctgatccaatgattccctaactgcagttctatttggcctatgcaaagttctgcactaaatcagcacacgaacgcctggatgatgtggttccatctggacaacctgcttgtttttagccaggtttctgatttattaatcgtgggcaagcgttttgtagaaattcaacaaagtttctagttgtaaaatagtatgtcaaggactttaacaaggtcccgaaccatcaaaggaggaacaaactccaacttcggatgtcatactagattccgaggatgatcttgttaccaaatataagaaagagaaaattagtcatgtagcattgaaaggttgctacttctggaaattactattgctggaaaatactgctgaaagatgccgctacgtaaataccattgaaagtgacaatccgttttg

SEQ ID NO: 107 - DNA, 2337 bp, Triticum aestivum
  misc_feature (217)..(217): n is a, c, g, or t
gagagagacccagggcacaaaagggaagcaaaagggcccccggggacagcgagaggtgtaggcagcagcagcagcagcagccgcagccagcggggaggctggttggtcgtcgcgggcggggatggagagcgagatgtcggacgcgcccccggcggccgcggccgtcgccgagccgctcgccgccgtggcggaggagggggagggggagggggaggcntccaccctcaccatggagcgcgtcgccgccgccaagaagttcatcgagaaccactaccgctcccacatgaagaacatccaggagcgcaaggagaggcgttttagactggagcggcagctagctacttctgaagttcccagggagcagcaaatcaatttaataaaagacctggagagaaaggaaactgagtacatgagacttaaaaggcacaaaatctgcgtggatgactttgagctgctcaccattattgggagaggcgcttttggagaggttcgactgtgccgggagaagacctctggcaacatatatgcaatgaaaaaactgaagaagtctgatatggttatcaggggtcaagtggagcatgttagagcagaaagaaacttgatggctgaagttgctagtcactgcactgtgaagctatactattctttccaagatacggagtatctttaccttattatggagtacctccctggcggtgatatcatgacccttctcatgagggaagataccttaactgaacccgtggctcgattctacattgctgagaccatccttgcyattgagtccattcataagcacaactacatccacagagatatcaagcctgataatctgcttctagacaagaatggtcacatgaagttgtcggattttgggctgtgcaaaccaattgattgttcaaagctctcaaccttgagcgaagatgaacccatgggcgatgacaacctgaaggagtcaatggatgtcgacagttcactctctgaaactgcaaatggtagaaggtggagaagtcaacatgaacaacttcagcactggcagatgaacagaagaaaactggcattctcaactgttggaaccccagactatattgctccagaagttctgctaaagaaaggatatggaatggaatgcgattggtggtctttgggtgcaataatgtatgagatgcttgttgggtatccaccattttattccgatgatccaataaccacatgcagaaagattgtgcactggagaaaccatgtgaaatttccagatgattcaaggctgtctcctgaggcaagagatctaatctgccggttattatgtgatgttgaccacaggattggtggtgcaggggctgatcaaataaaggcccatccttggttccgtggagttgcatgggataaactttatgaaatggaagcagcatttaagcctcaagtaaatgatgaattggatacacaraatttcatgaagtttgatgagatggataatagccctccagcaagaacaggttctgggccatcaagaaaggcgaagctgaattcaaaagatctcagctttgtgggatatacatacaaaaactttgatgctgtgaaaggattaaaacatgcagatatgcaaaggagctcatcgctaacaaggccctctattggtgctatattcggatcaaatggcatggagtcatcgagagaaccaaatggaaaggacacacacatgcacaccttttcttccggggatccgatgagtccataacccggcgtggttctgtttgttgctgagatttttctaaactaaattagcatgcaaacgactgaatgaagtggcttcgtctggacaacctgcttgtttttagccaggtttctgccctattaaatcgttggcgagcagtttgtagaaatccaagaaagcttctagctgtaaaatagtatgctaaggactagacaaatggtccatccaccggtgggctcgtcgtgtttggtgtagcgtgttccgaccaagtggagatgggcatgtttgggagggctggctgcccaggttggcagagcaaattgctgccttctcttgtggcagttcctggtccgctaacatttgatcatggaagcgaaataaggtggtaactgaggcaggctaagctattgttgttggtggtgtttgatacatatgtaccagaagatttccattcagagacatggcccttggtcaatggtctcccgttgcagaaatgcctaaatttttgtttactgtattgttcgccagttatatttgaacattgaacatttttggtggaagtgtcccttattttctttccgcaacatccatatgcaagaactgaattctgtgagagtgattat

SEQ ID NO: 108 - DNA, 850 bp, Brassica rapa
caaaacccgacaaatccacatctcatgtgctctgcccttaacaaaaggtccacaaccaaaccaaccaatcttgtcttttaccacctctatagctgtataccttttgcatcctttttgacatcttaaagtctctcaagaaacattctcagagactcattcacagaaagaaagaaagaaaagcatgggcgtctctctgttcgtcggcttcacccttctctcactctgtttgcccacttcaacatccgagcttctacagtttcagctctccaccatatcagctgcaccttcgtttttacccgaagcgccttctagtttctcagcttcacctccggaggctacgtctccggatatctctcctctgttccctactccgggttcgagcgaaatgtctccttctccgtcagaatcttctgccatgccgacaatcccctcaagccttagtccaccaaacccagatgctgtggctcgtgatcctctgcttgacacttctccggtggggtctcctctgcctgcatcttcctctgttgctttggtctggtcaccactctctctgcttcttgtgttccccatgttgctgctactacctttctccagattctctagttaaacacttagaaactgagattaaggccctcttgacatcatcctctgccaaaaaaaaacaaaaaacaaaaacaatgtattttccttgtaatttgatattattattattataccttttctattaattgttcgtatgaaaattgctaatgaacttcagccatttggctggtgcacttgttctacttgtaacacttgtgtttatgggtcttgtgcctcaaaaagaatcaaaattgattgatccaaataa

SEQ ID NO: 109 - DNA, 791 bp, Brassica rapa
  misc_feature (123)..(123): n is a, c, g, or t
  misc_feature (137)..(137): n is a, c, g, or t
ttctactcagaatatcaaaacatccaaacactcctacacaaatcaaagcatgacaaatcacgtttcatgtgatctgcccttatgcaaaaggtccacaactaaacccaccaatcttgtcttttnccttccctatagcngtatatattttcttgttcaatttctcgtccttttttaaccacctcctaaggtctcttcgcagatactcattcacagaaagagaccatgactgtcgtctctctgttagtcgccttcaccgttctttcactctgtttacacacttcaacatctgagctcctacagtttcagctctccaccatatcatcagctgcacctacgtttttgcctgaagctccttcgagtttctcagcttcacctctggaggctatgtctccagatatatctcctctgttccctactccaggttcaagcgaaacgtctccttctccgtcagaatcttttgacatgccgacaatcccctcgagccttagtccaccaaatccagatgccgtctctcctgatcctctgcttgactcttctcccgtggggtctcctcttccggcttcttcctctgtttctttggtctcgtcaccactctctctgcttctggtcttccccatgttaatactagctttctgcagattctaataaaatattttgaaacagagtgtgagagagtaagccctctttgacatcttgcttgaagaaaaagattcataatgtatactttttactctatgcttgtttatggaactttatttttcttgtataatttaatactactaaaaaaaaaa

SEQ ID NO: 110 - DNA, 628 bp, Brassica napus
gcagagactcattcacagaaagaaagaaagaaaagcatgggtgtctctctgttcgtcggcttcacccttctctcactctgtttgcccacttcaacatccgagcttctacagtttcagctctccaccatatcagctgcaccttcgtttttacccgaagcgccttctagtttctcagcttcacctccggaggctacgtctccggatatctctcctctgttccctactccgggttcgagcgaaatgtctccttctccgtcagaatcttctgccatgccgacaatcccctcaagccttagtccaccaaacccagatgctgtggctcgtgatcctctgcttgacacttctccggtggggtctcctctgcctgcatcttcctctgttgctttggtctggtcaccactctctctgcttcttgtgttccccatgttgctgctactacctttctccagattctctagttaaacacttagaaactgagattaaggccctcttgacatcatcctctgccaraaaaaaaaaacaaaaacaatgtattttycttgtaattttkatattattataccttttctattaattgttcgtatgaaaattggtaatgaacttcagccatttggctggtgcacttgtt

SEQ ID NO: 111 - DNA, 766 bp, Raphanus sativus
gggaaccccctaaggtctcttctcagagactgactcattcacaggaagaaaccatgaccgtcgtctctctgttagtggccttcaccgttctttcactctgtttacacacttcaacctcagagttcctagagtttcagctctccaccatatcagctgcaccttcgtttttgcctgaagctcctttgagtttctcagcttcacctcctctggaggctattatgtctcctgatatctctcctctgttccctactccaggctcaagcgaaatgtctccttctccgtcaggatcttttgacatgccgacaatcccctcgagtcttagtccaccaaatccagatgcagtctctcctcttgactcttctccggtggggtctcctcttccggtttcttcctctgtttctttggtctccttgacaccactctctctgcttcttgtcttcctcgtgtttatgctaccttactgcagactctaataaattattgtggaaaataagccctatttgacatcttgttcaaaacaaaaaaaaaaggaaaaaaagaattcacaatgtattcttctttttactctattcttctcatggaactttatttttctttgtataatataatgtttacacttcttttaattattgttcgggtgaggctctctgcaatctggccggtgcagaccgtgcagttgttgtacttgtaacagtgatatatgggttttgtgtatggattggatccaattatgaataatctctctcacatgttgccaaaaaaaaaa

SEQ ID NO: 112 - DNA, 674 bp, Antirrhinum majus
caccatattaaccgtagaagatgaggaagcttaaatttcatgagaagaagctgttgaagaaagtcaatttcttggaatggaagagagaaggcggtcagagagaaaacctcgttatgcatcgataccacgttacaggcagagacgactataaaaagtattcgagtttgtgtagaatggcgcagaagctggtgaacatactgaaacagatggatgctcgggatccttatcggattgagatgacggatgctcttctcgaaaagctgtacaacatgggtgtgataccatctcgtaaaagtttgaagttgtgtgagcgcttgtcagtatcatctttttgccggcgtaggcttgcaactatccttgtgcgactaaaatttgcagaacacttgaaagaagcaattacatatattgaacaagggcatattcgtgtaggacccgatactgttactgatccagcatttcttgttacaaggaatatggaggactttattacatgggtagatacatcaaagattaggagaaaggtcttggagtacaatgagaagttagatgactatgatgcaatgaactagctgttctttctttttccttttttgtatcctgttctggatcactgtattgtcttgttgaatttactgctcaattctcaaagtgtagctattgcttttgtcggtttg

SEQ ID NO: 113 - DNA, 848 bp, Malus domestica
aacacttcttccccttttttcctccacctagggttttagctctttcatctscctctgcggaaaagyaaccatgagrgagctcaagtttcatgagaagaagctgctgaagaaagtkaacttcttggamtggaagagagaagmaggtcacagagaaacycaggttctgcagcgytaccatgtcaccggtcgcgacgactacaaaaagtactcgggtttgtgccggatggtgcacaagctggtgaacatattgaagcagttgaacccgaacgatccgtatcggatcgaaatgaccgatatgctcttggaaaaactgtataatatcggtgttataccatccaagcaaagcttagcattatgtgagcgcttatcggtgtcatccctttgcagacggaggctttcaaccgttttggttcgattgaagtttgctgaacacctgaaagaagctgtcacatacatcgagcaaggacacatccgtgtcggtccagaaactgttactgacccagcattcctcgtgacaaggaatatggaagatttcattacatgggtggattcatcgaagattaggagaaaggtgctgcagtacaatgacaagctggacgactacgatgcaatgaattagggcatcgtaactttagggttctttcggccttcttctgttggtggccgaaaaaagaagaaccacatttagtttgcctggtgtatcatgtattaaacacctcagatggagggttccttcttttgttttaacacatttttctctacgggttcaatacatacatacttatcaagaatttcctattgaaatgagttcggcttctctcctaatctcctcactttcattgctaagt

SEQ ID NO: 114 - DNA, 901 bp, Arabidopsis thaliana
agggaccgtcggatttatctgacttcctctccttcgattagggtttctgaattactactcctctgccaattagggtttaagcctctccagcattttctttcagctcaaacccaagaacctcatcgccgattatttcttcatccttactctatcccgcgccgattaatctctctcagtaccgtccgagatgagaaagctcaagtatcacgagaagaagcttataaagaaagtaaatttcttagaatggaaaagagaaggtaaccatcgggaaaacgagattacgtatcgataccacatgggctctcgtgatgattacaaaaagtattcaggattgtgtaggatggtgcagaaactgacgaatataatgaaacaaatggatccagcagatccttttcgtattcagatgactgatatgcttttggagaagctatataacatgggtgttataccgactaggaaaagcttgactctaactgagcggttatcagtttcatccttctgtaggcgtaggctatctactgtgctggttcacctgaagtttgcagagcaccacaaagaagctgtgacatacatagagcaaggacacgttcgtgtaggaccagaaacaattactgatccagctttcttagtaactcggaacatggaagatttcatcacttgggttgattcatccaagattaaacgaaaggttcttgagtacaatgacacattggatgattatgacatgcttgcttagctttgaggaagttaaaaaagactgatgttttgtaaaagccaaaaaaggttcactgctactactattgcagggtttgtttggatttttgaatatgcaaatgtgctactattcccttgtctttaatcttactttcgatctatttgcaagaagaaacttgaaaacaaa

SEQ ID NO: 115 - DNA, 802 bp, Brassica rapa
ttttgattttagggtttttttttctgctcataaacctcactgatcctcgctcagtgccggactctctcacttaatctccctcatcccttccatagccgtaagtgatgaggaagctcaagtttcatgagacgaagcttataaggaaaacaaacttcttggaatggaagagagaaggtggccatcgcgaaaacctcattacgcgtcgttaccacatgggtggtcgtgacgattacaaaaartaytcagggttgtgtaggatggtgcagaagctgacgaatgtaatgaaacagatggacccaactgatccttttcgggttcagatgactgatttgctcctagagaaactatacaacatgggagttataccgactaggaaaagcttggctttaactgatcgcttatcagtttcctccttctgcaggcgtaggctatcgacwgtactggttcacctgaagtacgcagagcacttgacagaagctgtgacgtatatagagcaaggacacattcgtgtaggaccagacacgattactgatccagctttcttagtaacaaggaacatggaagatttcatcacttgggttgattcttccaagattaaacgcaaggtgcttcagtacaatgacaaattagatgactacgacatgcttgcttgattttgagagaggagattagaaaaaaacagattgatgttttggatttactatttagtgaacatatatatatatttacttgacatttctgtgagttggaatcaaaaggcagaaatttcatcttaatgcatttttgtaaatgtatcatctta

SEQ ID NO: 116 - DNA, 1259 bp, Brassica rapa
ggcgacttagggttttagcataaacctcgccgcaccctctctctgtttaagccgtcttacatctgcgrsgragaacccttaatttcgcgctctttgcatcaccttgagaagggtcagcgatgaggaagctcaagaaccatgagaagaaggttctgaagaaagtaaatttcctggaatggaaaagagaaggcggccatcgcgaaaccctgatcacgggtcgttaccacatgggtggtcgtgrcgactacaaaaaatattcaggattgtgtaggatggtgcagaagctgacgaacgtgttgaaacagatggatgcgactgatccttttaggattcagatgactgatatgcthctcgagaagctatacaacatgggagttataccgacaaggaaaagcttggctttaactgatcggttatcagtttcctccttctgcaggcgtaggttatcgactgtgttggttcacctgaagtacgctgagcacttgacagaggcagtgacatacatagagcaaggacacatccgtgtaggaccagacacgatcactgatccagccttcttagtaactcggaacatggaagatttcatcacytgggtggactcttccaagattaaacgcaaggtgcttcartacaacgacaarttggatgactacgacatgcttgcttagatttrtctcacttctcaaagtgtaaaccttttctattaccaaactatatgtttctcattaatcatcaaaccttttgcaatagattcagaccaaagcttagagtaagacaagaaaacaaagattcaatcaaaagtactttgacatctgaatccctttattaaccaacccacatttctcgtagaactctttcttctccacgccacaatcaagaatcaccttgtagcaacccatccctcgacaatgatccgttagaaactcaaccactcgcttcccgagacgtttcccgcggaactctgtatccacgacgacgtcctctacatgcccgactttgccgcagtttctcaggaacttcttctctatcatcacgctccccgtcgccgcgatcttacctgatgactcttcttcgatgacgcagatcaaatggtcgtctccgtaggaggtgatctccttgaaacgctgatcgaattcgtcgtcggtgactgatcctgtgacggtgagttggctgagaagctccatgtatccatttctcttgtcggtgatctctarssktcggatcttgaatgtctgtttctctccggtgatgtcggaact

SEQ ID NO: 117 - DNA, 902 bp, Phaseolus coccineus
atgggggggggtcgtcttgcagttctgagtcctcatcactctgccgcctcgtcctgcggcgttctcctctctctatctccgcttctgtcctctcttctttctctcgccgccgccgcgctgtcgtctcatcgctatttctttctttctattagcaagttgcccgagacagtcacggaagccaactaacggtgaaaaagaatgaggaagctcaagtttcatgaaaagaagcttttaaagaaggtaaattttttggaatggaagagggaagggggtcacagagagaacttggttatgcaacgttaccatgttactggacgggacgattacaaaaaatattcaggtttatgccatatggttcagaagttagttaacatattgaaacagatggatgcaaaggatccttttcgagttgacatgactgacaagcttttggaaaaactctacaatatgggcgtgattccaaccaggcaaagcatcacactctgtgaacgcttaactgtgtcatccttctgtagacgtaggctctcaactgttctggttcgactcaaatttgctgaacacttgaaagaagcagtcacgtatattgagcaagggcatattagggttggtccagagacagtgacagacccagctttccttgtcactagaaacatggaagacttcattacatgggtggattcatccaaaataaagagaaaggtgcttcagtacaatgacaaattggatgactatgatttaatgaattaagtggaaggctaaatgtcagcttattgtggtttgcttactaatatgaaatcatgggtgagtttgttccctggggccgtttaggcaggcttggatttttatgagattattttaaattttaaattcataccagattaagttgagggtgatgtaatgaa

SEQ ID NO: 118 - DNA, 963 bp, Theobroma cacao
cggggctctttcaaatccagccaccaacggcggcacaggtcaccgttcttccctccctttctcttccttttttcctgtgtgtaaacaaggatgaggcggctaaagtttcatgagaagaagctgttgaagaaagtaaattttttggaatggaaaagagaaggtggccaccgagagaatctcgttatgcaccgttatcatgtcactggtcgtgacgattacaagaaatattcgagtttgtgccggatggtgcagaagttggtcaacatattgaagcagatggaccccagagacccttttcgtatcgagatgactgatttgctcttagagaagctatacaatatgggcgtaatcccaaccaggaaaagcttggctctgtgtgatcggttatcagtatcgtccttttgtagacgtaggctttcaactgtcttggtgcacctaaagtttgcagagcacttaaaagaagcagtcacatatattgagcagggccatattcgagtgggtccagagaccatgacgaacccagcattccttgtaacaaggaacatggaagacttcattacgtgggtagacacatctaagatacggaggaaggtgctggaatataatgagaagttagatgattatgatgcaatgaactgaaaaaatacacctgagtttaacttatataacttatttcattggcattcttcgcaaagatgtacactgataaaaggtgtgagtgatggaatacttgatgaagttggattccatggtgccgtgaagtgagagacttttgagatcctaatatgatataggtttctacttttcattttgttttctatattytcagttgtgactcagaaggtgattgagggttttgttgtgttatatgttgattctgtagttgggggaaggagttcttcaatgcatttaaaaattttctcggaactttggctttattcatataatatgattatacttgtc

SEQ ID NO: 119 - DNA, 742 bp, Brassica napus
gaggttttaggttttaggktttttttttctgctcrtaaacctcactgatcctckctcagygccgraytctctcacttaatctccctcatcccttccatagscgtmagtgatgaggaagctcargtttcatgagamgaagmttataaggaaaacraacttcttggaatggaagagagaaggtggccatcgcgaaaacctcatyacgmstcgtwaccacrtgggtggtcgtgacgattacaaaaaatattcagggttgtgtaggatggtgcagaagctgacgaatgtaatgaaacagatggacccaactgatccttttcggattcagatgactgatttgctcctagagaaactatacaacatgggagttataccgactaggaaaagcttggctttaactgatcgcttatcagtttcctccttctgcaggcgtaggctatcgacwgtactggttcmcctgaagtamgcagagcacttgacagaagctgtgacgtatatagagcaaggacacattcgtgtaggaccagacacgattactgatccagctttyttagtaacaaggaacatggaagatttcatcacttgggttgattcttccaagattaaacgcaaggtgcttcagtacaatgacaaattagatgactacgacatgcttgcttgattttgagagaggagattagaaaaaaacagattgatgttttggatttactatttagtgaacatatatatatatttacggggcatt

SEQ ID NO: 120 - DNA, 733 bp, Centaurea maculosa
ggcggggaatttcagggtttagcttttcttcttcttcccaaaccctatctctgttcttccaaaatcttcagaattcgcgtttcgattatcgtaaatcgatcgaagataagatgaggaagttgaagtttcatgaaaagaagcttctgaagaaggtcaatttcttggaatggaagcgagaaggaggtcacagagargctcaggtgatgcatcgttatcatgttactggccgtgatgattacaagaagtactctggtttgtgtagaatggcacagaagctagtgaacatattgaagcarayggatcctagagatccttatcraatcgagatgacggatgcccttcttgaaaagctgtacaacatgggtgtgataccatctcagaaaagcttrgcattgtgtgatcgcttatcygtttcatcrttttgtcgacgtaggcttgcractttattggtgcgattaaaatttgccgarcacttgaaagaagcygtgacatatatwgaacaaggrcatatccgagtgggtccagataccgtwactgacccygcrttyctagtaacaagaaacatggaagatttcgtcacttgggtagatacgtccaagataaagagaaaagtcatggtgtataacgataagttggatgrytacgatgcaatggtmtgagaaaaaagacctrcaagaaagttcatggcgttatgacatttggcgtgtccgcttgaaggtmgtwwgmtmtkgta

SEQ ID NO: 121 - DNA, 1281 bp, Citrus sinensis
ccacgcgtccgtctctcttcatcaaattttcttaaaatttagcagcatcgtttactaaagcaaagaatcataatgaggaagctaaagttccatgagaagaagttgttaaaaaaagtcaattttttagaatggaaaagagaaggtggccacagggaagccatgataatgcagcggtaccacgtcaccggccgcgacgattacaagaagtattcaagtttgtgcgggatggtgcagaagctggttaatatattgaagcagatggatccaagagatccttttcgtattgagatgactgatatgcttctcgagaagctatataacatgggtgtaataccaagcaggaaaagcttggctttgtgtgatcatctatcagtttcatccttctgtagacgcaggcttgccaccattttggtgcggttgaagtttgctgagcacctgaaagaagctgtgacgtatattgaacagggacacattcgagtcggaccggagacagttacagaccctgcattcctcgtgaccaggaatatggaagactttattacatgggtagatacatccaagataaagagaaaggtcttggaatacaatgataaggtggatgattatgatgcaatgaactgaagacccattaagatctgttttttcttttgtttctgaacatttttgtttgaatttcatgttgtacgatgtttatatgggcaattaaaagttaacttgttttcaattctctgttgccagaaatagtgagcatccgagtagcattcccaagaaaagtttgtattttgtttgtacatataacacgatttgtaccatcaccagcaaattttgtcacattatcattgacttcaaaaaaaaaaaaaaaaaaaaaacccaattttcttggaaaaaagtgggatttaataaaaaagctttgctttataaatttgtttgcaaccgaaagggctacatcccatcaaaaataaaattttttttttgccctccaggcgtatatcccccaaaggtgggtggtattatttggggccttaatgtggtttctgggggcacccgggcccccggggttctaaaatctttgttggtttagtttctccaaaataaaaaaaaaaaccactctcctgtggaaaaaaaaaccccccctggacccgcgaaatatacaccgcgcgtttgttttattctatcctacgggaattctatttcgccctcactattacttcttcaacaaacggcccctatccctgcccactaactacacagtgtaagacaaaaaaatgacaccactccacc

SEQ ID NO: 122 - DNA, 921 bp, Gossypium hirsutum
ctytttctcttccaatttaaagctgccgctgaattttcttaagtagccataggatgaggaagctaaagtttcatgagaaaaaactgttgaagaaagtaaattttttggaatggaaaagagaaggtggtcaccgggagaatctcattctgcatcgttatcatgtcactggtcgtgacgattataagaaatattccggtttgtgccggatggtccagaaattggtgaatatattgaagcagatggatcctcgagacccttttcgaatcgagatgactgatttgctgttagagaaactatacaatatgggcgtaatcccaaccaggaaaagcttggctctatgtgatcggttatcagtgtcatctttttgtaggcgtaggctctcaaccgtgctggtgcacctaaagtttgcagaacacttgaaagaagcagtcacgtatattgagcagggacacattcgtgttggtccagagacagtgacagacccggcattccttgtaacaaggaacatggaagacttcattacatgggtagacacatcgaaaatacggaggaaagtgttggaatacaatgagaagttggatgattatgatgcaatgaactgaaacctttttcaggagcattcttcaccgtacgtaaaactcttccaaggcgtaggtcacggtgatacataattcctgtgttgctgcgaattgagagacccattagatcatccaatgacataggtgtctcattctgtttctgtttactattatattctcagttttgtctctgaaggggagtaagggtttgctttgttattttaggcaccttttttttgggttttacttctattggcatgttttatattacaagttttatttataattttagatgataaagtgtttgaatcttggtttttatattggttgataataaatttgg

SEQ ID NO: 123 - DNA, 984 bp, Vigna unguiculata
gggcgtccgtgccattctttcttctckktctctcacacgcccagtgcagagtgctcatcaccatcttcatcggcgacgacaccgccaggaacatccgaacaagcatcaagttcattggtttcacctctctttcaatccctttactttggaaatcccgtttctgaggtgctgtccaccaattgttcattggttatccttctgtcactttcaactggtgaaaaagaatgaggaagctaaagttccatgaaaagaagcttttgaagaaggtaaattttttggaatggaagagagaaggtggtcacagagagaacttggttatgcaacgccaccacattactggacgggacgattacaaaaaatattcaggtttatgccatatggttcagaagttagttaacatagtgaaacagatggacgcaaaggatccttttagggttgacatgactgacaagcttttggaaaaactctacaacatgggcgtgattccaaccaggcaaagcatcacactatgtgaacgcttaactgtgtcatccttctgtagacgtaggctctcaactgttctggtgcgattaaaatttgctgaacacttgaaagaagctgtcacgtacattgagcaagggcatataagggttggtccagagacggtgacagacccggctttccttgtaactaggaacatggaagacttcattacatgggtggattcatccaaaataaagagaaaggtgcttcagtacaatgacaaattggatgactatgatttaatgaattaagttgaaggctaaatgtcagcttattgttgtttgctttcaaaatatgaaatctgggatgagttttttttttccttgggggcggtggtttagataggcttggattttaatgggattgttttaagttttaaattcataccagattaagttgatgaagatgtaatgaacctggaaattagtgaatcagtatttaaaattrttctgcatttttcca

SEQ ID NO: 124 - DNA, 763 bp, Cynara scolymus
tatttgggatcaatttttagggttaagctttttcttctccaaccctctgttcctttttgattcgcgtttctgtttccataactcaatcgatagaagatgaggaagctgaagtttcatgaaaagaagctactgaagaaggtcaatttcttggaatggaagagagaaggaggtcacagagaagctcaggttatgcatcggtatcatgttactggccgtgatgattacaagaagtactcgagtttgtgtagaatggcacagaaactagtgaacatattgaagcagatggatcctagagacccttatcgaatcgagatgacggatgccctccttgaaaagctgtacaacatgggtgtgataccatctcaaaaaagcttagcgttgtgtgatcgcttatccgtttcttcattttgtcgacgtaggcttgcaactttattggtgcgattgaaatttgccgaacacttgaaggaagctgtgacatatatagaacaagggcatatccgagtgggcccagatactgttaccgatcccgcatttctagtaacaagaaacatggaagatttcgtcacttgggtagatacatccaagattaagagaaaagtcatggtgtataacgataagttggatgattatgatgcaatggtctgagaaaagatcctcaaaaagttttcatttgccgttggcggaacaccacgaagggtatgctttctgtcctatgtcgagatcatattcatggctttatgacattggcgttaacatgatcgct

SEQ ID NO: 125 - DNA, 801 bp, Taraxacum officinale
ggcgggggtcggcatttakggcaagacgactamagccgcaaggaggcggtaagcagccaagaattacgtccagagtyrgtcattgagtgatcgagtcwyagkttyttacgccatatattttgtctagggtctaatcgattcttattcaaccctcggtttctttgctttgytcacgcttctatttcgtarcttgatcgarttgagtgtaatccgagaagatgaggaagctcaaatttcatgagaagaagctactgaagaaggttaatttcctsgaatggaagagagaaggcggtcacagagaagctcaggtcatgcaccggtaccatgttaccggccgwgacgactacaagaagtactcgagtttgtgtagaatggcacagaaactagtgaacatattaaagcagatggatcctagagatccatatcgaatagagatgacagattcyctcctagaaaagctttacaacatgggcgtaatcccatctcagaaaagcttagcactatgtgaccgattatccgtttcatctttttgccgacgaaggctggcgactgtactggtgcggttgaaatttgccgaacatttgarggaagccgtgacttatatagaacaagggcatatcagagtgggtccagacactgttacagaccctgcttttttggtaacaagaaatatggaagatttatcacgtgggttgatacttcgaagattaaaagaaargtcatggtctataatgataagctgatgattatgatgccayggcttgattaatatcaattagatttgttttgtattggattttt

SEQ ID NO: 126 - DNA, 711 bp, Vitis vinifera
aggaaggatgaggaagctcaagttccatgagaagaagcttctgaagaaggtgaatttcctagaatggaagagagaaggtggtcacagggaagcccatgttatgcaccgctaccatgtcacgggccgagacgattacaaaaaatattcgggtttgtgccggatggtgcaaaagcttgtgaacattttgaagcagatggacccgagagatcctttccgaattgagatgactgatacgcttttggaaaaactgtacaacattggtgtgataccaaccagaaaaagcttggcactgtgtgatcgcttagcagtgtcatccttttgtaggcgtaggctttcaactgtgttggtgcgattgaagtttgcagagcacttgaaagaagctgtaacgtacattgagcaaggacacatccgggtgggtccagacacagtgactgacccagcatttcttgtgacgaggaatttggaggactttgtgacatgggtagattcatccaagattaaaagaaaggtgctccagtacaatgagaggttggatgattatgatgccatgaactgaacaacttgaaaatggaagctttgatttggtatctgattgtttttactgtagcattttttttgtctaatgatgacagcaaaacgactgcaagtggtgtattgatgaaggatatttattttgcacattgcctaatatgcattttaattttgatgcca

SEQ ID NO: 127 - DNA, 814 bp, Ipomoea nil
tcagggtttaggttaagggaaggtttttggtatcctccgttggtgaattctttgctgatttacatacagttccgaggtaactagaatcgtagaaagatgaggaagctgaagtttcatgagaagaagctggtgaagaaggcgaactttctagaatggaagagagagcatggccaccgagaagctcttgttatgcatcgctaccacgtcacaggaagagacgactacaagaagtactcaggattgtgtagaatgacacagaagctggtgaatatactgaagcaaatggacgcaagagatccgtttcgtattgaaatgaccgatgcccttctcgaaaagctgtataacatgggtgtgatatcagaacggaaaagtttagcattgtgtgataagctatcagtttcatccttctgtaggcgtagactctccactgtcttggtcaagctaaagtttgctgaacacttgaaggaagctgtgacatatatagaacaggggcatattcgagttggaccagataccattactgatccagcatttctggttacaagaaatatggaagactttattacatgggtggatacttcaaagataagaagaaaggtcttagagtacaatgagaagttggatgactatgatgctttgaactcgtgaatccatgaggacactccaaaaaaccacactgaaattttagtggtttttcttattccttttcatcatgtaatcttactcagaagtgctttcttcttggcggctctcattgagggcttagttaacaagccaatgtccttatatttattacataaaaacatgtttgaat

SEQ ID NO: 128 - DNA, 660 bp, Actinidia deliciosa
caaaaaaagacctagcttccttcctccgcttgcccgagttcagcagcttcagctctgttccccattgctactgagcgctctctctctctctctaagtatgagaaagctcaagtttcatgagaagaagctattgaagaaggttaatttcctagaatggaagagagaaggcggccacagggaagctcaggttatgcagcgttatcacgtcaccggccgagacgattacaagaagtattcggttctgtgtcggaatgtgcagaagctggtgaacatattgaagcaaatggacccaagagacccttttcgggtcgagatgaccgatgctctcctggaaaagctgtataaccttggtgtcataccatctagaaaaagcttggctttgtgtgaccgattatcagtgtcatccttctgccggcgcaggctctcaaccgttctagtacggctgaagttcgctgaacacttgaaggaagccatcacatatatagagcaaggacatatccgagtgggtccagagacggttactgacccggcattccttgtgactagaaacatggaagacttcattacttgggtggattcgtccaagataaagagaaaagtgctggagtacaatgagaagctcgacgattatgatgcaatgaactgaggmagatcatggca

SEQ ID NO: 129 - DNA, 692 bp, Lactuca sativa
ggttatcacctccggccactccatcactttcctccccagcgcgccactccatcaccttcctccgctagcgccgccgacttgtaagtcgataacaagatgaggaagctcaagtttcacgagaagaagctactgaagaaagttaatttcttggaatggaagagagaaggtggacacagagaagctcatgtcatgcatcgctaccatgttaccggtcgtgacgactacaagaagtactcgagtctgtgtagaatggcgcaaaaactcgtaaacattttgaagcagatggatcctagagatccttacagaatcgaaatgacagatgcccttcttgaaaaactatacaacatgggtgtgattccatctcaaaaaagcttagcattatgtgacaaattatccgtttcatcgttttgtagacgtaggcttgcgactgttttggtgagattgaaatttgctgaacatttgaavgaggctgtgacttatatagaacagggacatgtgagagtgggcccggatacagttrcagatcctgcttttttggtaacaagaaatatggaagattttataacgtgggttgatacatccaaaattaaaagaaaggttatggtgtataatgataagcttgatgattatgatgcaatggtttgaatttgattcgaatcttaatggttwatgggtttgtgacatttttgttt

SEQ ID NO: 130 - DNA, 917 bp, Cucumis melo
acacttttaattttctataccctaacattaaatctattgtctctcccaagtctcggcggtcgccgtgtcgccgtcaccatcgctgccgttcaacttctctttctctctcttctgttctcccatctccttctcaatcctctatctctactcttctccacagagattctttttgttcgaaccacaccgagaccttcttcagctgcgaagtgtcgtgaggtgaaacagaaggatgaggaagctaaagtttcacgagcagaagcttttgaagaaggttaacttcttggaatggaagagagaaggaggtcacagagaagcccaagtaatgcatcgctatcacattactggacgggatgattacaagaagtattcgagcttgtgccgtggtgttcagaagctggtcacaatgctgaagaagatgaacgagaaagacccttttcgattggaattgaccgagaagctcctcgaaaagctgtacaatatgggtgtgataccaacccgacagagcttgaatttatgtgatcgcctgtcagtatcatccttttgcagacggaggctatcgacagtgttggtacgtttgaagtttgccgagcatttgagggaagcagttacatacattgaacaagggcacattagagttggtccagagacggtaactgatcctgcatttctagttacgagaaatatggaggacttcataacatgggttgattcatcaaagataaagagaaaggttctacaatacaatgatcagttggatgattatgatgctattaactgttgagatactgtccaagttttgtttctttttcattatttcatcttgtatgaatcttttctctggtactcttatcgaaatggctatttaaggtagcgwaagttttgccctttcttttctaatcaatatatataattttacg

SEQ ID NO: 131 - DNA, 749 bp, Raphanus sativus
actcagggtttaagcgcctcaacctcaccgccttcttgagctacctcatcccgtcgagctaatcttctctctcagaagcgtgagtaatgaggaagctcaagtaccatgagaagaaggttctgaagaaagttaatttcctggaatggaaaagagaacgtggtcatctcgaaaacctcatcacgggtcgttaccacatgggtggtcgtgacgactacaaaaaatattcaggattgagtaggatggttcagaagctgacgaatgtattgaaacagatggatgcaactgatccttttcgtattcagatgactgataaccttctcgagaagctatacaacatgggcgttataccaactaggaaaagcttggctttaactgatcggttatcagtttcctccttctgtaggcgtaggttatcaactgtgctggttcacctcaagtacgcagagcacttgaaagaagctgtgacatacatagagcaaggacacattcgtgtaggaccagacactatcactgatccagccttcttagtaactcggaacatggaagatttcatcacttgggttgattcttccaagatcaaacgcaaggtgcttcagtacaatgacaagttggatgattacgacatgatgcttgcttaactctctctctatttgtcttgcttctcaaaagtgtaaaccttttttctctattgccaaactatatgttttcattacttatcaaaccttttgcaacagatttaagaccaaagc

SEQ ID NO: 132 - DNA, 791 bp, Raphanus sativus
tcctctcttccactcagggtttaagcgcctcaacctcaccgccttcttgagctacctcatcccgtcgagctaatcttctctctcagaagcgtgagtaatgaggaagctcaagtaccacgagaagaaggttctgaagaaagttaatttcctggaatggaaaagagaacgtggtcatctcgaaaacctcatcacgggtcgttaccacatgggtggtcgtgacgactacaaaaaatattcaggattgagtaggatggttcagaagctgacgaatgtattgaaacagatggatgcaactgatccttttcgtattcagatgactgataaccttctcgagaagctatacaacatgggagttataccgactaggaaaagcttggctttaactgatcggttatcagtctcctccttctgtaggcgtaggctatcaactgtgctggttcacctcaagtacgcagagcacttgaaagaagctgtgacatacatagagcaaggacacattcgtgtaggaccagacactatcactgatccagccttcttagtaactcggaacatggaagatttcatcacttgggttgattcttccaagatcaaacgcaaggtgcttcaatacaatgacaagttggatgactacgacatgatgcttgcttaactcaactctctcttaagataatatttgtcttgcttctcaaaagtgtaaacctttttctattgccaaactatgttttcattacttatcaaaaccttttgcaacagattaagaccaaagcaagaacataacgaaagtttcaacc

SEQ ID NO: 133 - DNA, 919 bp, Glycine max
acgccgttctttgccctcatctctctctcgccggcgtcgctacgaaggaaagcaatttactgtgaagaacaatgaggaagctaaagtttcatgaaaagaagcttttgaagaaggttaattttttggaatggaagagggaagggggtcacagagagaacctcattatgcaacgctaccatgttactggacgggacgattacaaaaaatattcaggtttatgccatatggttcagaagttagtaaacatattgaaacagatggacccaaaggatccttttcgggttgatatgactgataagcttttggagaaactctacaacatgggtgtgattccaaccaggcaaagcatcacactatgcgaacgtttaactgtgtcatccttctgtaggcgtaggctctcaactgttttggtgagactaaaatttgctgagcacttgaaagaagctgtcacgtacattgagcaagggcatatacgagttggtccagagacagttacagacccggctttccttgtaactagaaacatggaagacttcgttacatgggtggattcatccaaaataaagagaaaggtgcttcagtacaatgacaaattggatgactatgatttaatgaattaagtggaaagctaaatgtcagcttattgtggtttactatatatgaatcatggacgagttttgtttccttaggcgggtagtttagacaggcttggattttaatgggattatttttaatttaaatgcataccagatgattaaggtgatgatgtaatgagcctggaaattactgaatcatgatagtgatgttaaatgtttaaatgtattttgcttttttccagtcaatttttagggatcactgctgccccagcttggattttaagtgaatgatgatccattgtggtcgattggcgttgggacaa

SEQ ID NO: 134 - DNA, 1034 bp, Glycine max
ctttggcgctgtcgccgttcttagccctagtctctctgtctctcgtcgcctctctgcaagttagctgggacaagccaccaaggaaaacattttactgtgaagaacaatgaggaagcttaagtttcatgaaaagaagcttttgaagaaggttaattttttggaatggaagagggaagggggtcacagagagaacctcattatgcaacgctaccatgttactggacgggacgattacaaaaaatattcaggtttatgccatatggttcagaagttagtaaacatattgaaacagatggacccaaaggatccctttcgggttgatatgactgataagcttttggagaaactctacaacatgggtgtgattccaaccaggcaaagcatcacactctgcgaacgcttaactgtgtcatccttctgtaggcgtaggctctcaactgttttggtgcgactaaaatttgctgagcacttgaaagaagctgtcacgtacattgaacaagggcatatacgagttggtccagagacagttacagacccagctttccttgtaactagaaacatggaagacttcgttacatgggtggattcatccaaaataaagagaaaggtgcttcagtacaatgacaaattggatgactatgatttaatgaattaagtggaaagctaaatgtcagcttattgtggtttactatatatgaatcatggacgagtttgtttccttaggcgtgtagtttagacaggcttgggttatttttaattttaaattcataccagatgaaggtgatatgatgtaatgaacctggaaattactgaatcatgatagtgatgttaaatgtttaaaatgtattcttcatttctccaatcaattgtttagggatcacagctgccccagcttggattttaagtgaatgatgatccattgtggttgattggcgatgggacagtaacaaggtttttaaagggtagcctgtctttgcatggatctgcctttttggtcttgctacagcataataatagtttaattattatttaga

SEQ ID NO: 135 - DNA, 801 bp, Helianthus annuus
atcaattgagtgtmagaagtaagagacgatgaggaagctgaagtttcatgagaagaagctgctgaaaaaggtcaactttctggaatggaagagagaaggcggtcaccgtgaagctcacgttatgcaccgttatcacgttaccggccgtgatgactacaagaagtactcgagtttgtgtagaatgacacagaagctagtgaacatattgaaacagatggatcccaaagacccatatcgtatcgagatgactgatgcyctccttgaaaagctgtacaacatgggtgtgataccatctcaaaaaagcttagctttgtgtgatcgcttatctgtgtcatccttctgtcgtcgtcggcttgcaactgtattggtgaggttgaagtttgctgaacacttaaaggaagctgtgacatatatagaacaaggacacatccgtgtgggaccagatacggttactgacccagcatttctagtaacaagaaacatggaagattttattacatgggtagatacatccaagattaagagaaaagtcatggtgtataatgacaagcttgacgattatgatgcaatggcttgagtgacatctgcatgttcaatattgagttcctcaaaccctgacgaccaatatgcgcgtagttgccgagaaggatcttgatagctttctttaacttgaaggccatggttgtattggtcatttttgctactctgtattcaatcataccgtcttttgtcattaattctagttaaaggtttggtctattgtttrcttgcaagtttgctatgagatcattccatggttgt

SEQ ID NO: 136 - DNA, 885 bp, Thellungiella halophila
gatctcctctctgcctttaggttctgctcaaaaacctcacctcctttttaggttgattatctttgctctgcgccgccgcgaattctctcttaatctcactcaataatccctcccagtttgcgtaccctcagaaacgtccgtgatgaggaagttaaagccccatgagaagaagcttctgaagaaagtaaatttcttagtatggaaaagagaaggtgggcatcgggaacacctaattacccatcgataccacatgggagagcgtgatgattacaaaaagtattcaggtttgtgtaggatggtgcagaaactgacgaatgtgtgaagcagatggatccagctgatcctttysggattcagatgacagatacgcttttggagaagctgtacaacatgggcgttataccgactaggaaaagcttggctttgactgagcggttatcagtttcgtccttctgcagacgtaggctatcgactgtgcttgttcacctgaagtatgcagagcacttgaaagaagctgtgacatatatagagcaaggacacattcgtataggaccagatacagttactgatccagctttcttagtgactcggaacatggaagatttcatcacttgggttgattcttccaagatcaaacgaaaggtgcttcagtacaatgacaaattggatgactatgacatgattgcttaacttttgaggagattaagttattgtgatgatgctttcgtgttttgtataagccaagaaagtttcagtgctttatttattatgcaaggtttggatattttggttatattctttgtggaatatggcaaatgttaactatgttactgatactattcactttttatttttacaatgtaaggaaagagaaaataccataat

SEQ ID NO: 137 - DNA, 890 bp, Triphysaria pusilla
gaactagcgccattagtgagggagaattctattttttacggttttagccgaagtcttactcttatctcctctctgagctcattctccacctctgcacccgtagatcatgaggaagctaaagtttcacgagaagaaattactgaagaaagtcaatttcttagaatggaagagagaaggtggtcagagggaaaacagtataatacatcgttatcacatcactgccagagacgactataaaaagtattcgagtttgtgtagaatggtgcagaagctagtgaacatcctgaaacaaatggattcgagagatccttacagaatccagatgactgacgcgcttcttgaaaaactgtacaacatgggtgttataccatctcgtaaaagtttggctttgtgcgagcgattgtcagtctcatctttttgccggcgtaggattgcaacacttctggtaaagttgaaattcgccgagcacttgaaagaagcagttacatatatcgaacaagggcatattcgcgtgggacccgataccattaccgatccagcattccttgtcactaggaatatggaggacttcataacatgggtagatacatccaagattaggaggaaggttttggagtacaatgacaagttggacgactttgatgccatgaattaattaatgtttctccgagtcttgttagcgcgattatggccttgtcgctcattattcrtttcwggagtattgtatgttctgctggcttatggtattgttgtttttctgttatgcttttcttgtcttgktctaaattataccattttgcatttgaacacatatttartgtcatttgtcagtcaataactttctctcgtgttgatttatcagtatatttgttggtcgaacaaaaaaaaaa

SEQ ID NO: 138 - DNA, 3011 bp, Arabidopsis thaliana
taaaataatattaaaaaaaagacagagaaagagtctctgtttctatcttcttctttttttttcccggtaacagggagctcgcacgggcggctacgaaatcgctgtattttcaaatcgtctctcagtttccatgacttcagatgctctcactataccatctgagcttgaatctgccttgcggctcaggactgtacaatactttattacaaaaaggccttggcttgatctttatggagtccatgtgaggcctgtgccaccattcggaagtacaagccgtaaacctcattttgatccagctttgattcatcgttgcttgcctgatgagcttcttttcgaggtgtttgctcggatgatgccttatgacttaggtagagcatcttgtgtttgtagaaagtggaggtacacagttcgaaaccctatgttctggcgtaatgcctgcttgaaagcttggcagactgctggggttatcgaaaactataagatcttgcagtctaaatatgatggatcatggaggaaaatgtggcttcttagatccagagttcgtactgatggtctttatgtgagtaggaatacttacattcgagctggaattgctgagtggaagattacaaatccagttcacattgtttgttactaccgctacataaggttctacccttctggcagatttctttacaagaactcttcacagaaattgaaggatgttgccaagtacatgaactttaaggcttctaaatctgaaaatctttacaaaggcacttatacactgtcaatgtcggatgataagatcgaagcagctgttctgtacccagggacacgccctactgtcttaaggattcgtttaaggttaagaggaacagctattggagcgaataacaggatggatttgctgtcacttgtgacaagtggtgtgaacgatgaggaaataagcagcacagaagaagacattcttgggttagttgaaggttgggaagacgatgaaactcacaacccggatatacctgccgtctcacacaagaggggtatgactgcattcgtcttcgttcctttcgaagaggttgacgaatcggttctgaacttgccaccggagaaaatggattactatgtcactggctaaagagacacatcgaagtttctgtacaaaaatgtatcatagaataatgttttcacgttatatttattgttacgacaaacattagtgtttgtttgttgctgtcgaattgtgaaaaacatacattttgggatttttgtttgtttacagagattacttgaaacaagctttactattgtaagataatgttttcaagtttttattatacaccaaaaggctttaaagcaggacttgatcagatgctagacttgaggttcttggaatcatcctctgagtgaaccagacgctgccacgttgggtttcgatgaagaaacgtttcctgcaaaacacgacatattttcataagaatctgattcatctcaattttttgaggaaagaagagatgtatacggaaacgtaggagcaagtggggatgatggagaaagagtgttcagaggcgtgttcgaaagcggcgacgcatagatgcgaagctaaaccaagtcctgcttttgacggcggtacgaaggttcgaaccagatccatgactttaccgtcattcttcatcttgtactctatgaaggcttcgtgatcatcagtctcgaatctatgtcttccttcgttccacacgatcttcggtttctccgtcgccgtccccgtcgccattttatctgttatctctctaagtctaagcgatggaggcggcagagtgttttgcttgcttcgtcgtgttatttggcgtgaagtaaagagttcagagagaaaaggaagtcaaaacttcagagagaaagtggatgggggacacgaaggtagagacaatctcgaggttagctcaatggagaattgaaaattttggtccttgttctttcaaaaagtccgatcctttcaaagtcggaatttggaattggcatctgtctatagagaggaatcgctatctatcagtgaggctattcccagaactttctcgagtatctaaagagcaacctcctgttgccaaatttgttcttcgtgtctccaacgttggccccaatcgtagattctacatctctcctgtttatgagaagctgctgcgtacaactgatgattgtgtgtggcatgttgactccagtttccacggtcgattcaccattgatgttgagtttcttgatctcaaaatctgccctgtgaatggtggtgaagcttctcctgtttggccaaccgatgcaacaatgcaatcaatctctactcaaaccactctcaaatgcttatcccggatgctagaggaaagcatactaaccgatgtaatcatccacacagccgatggaacactctctgctcacaaagctatcctctcagctagctcaactgttttcaaaagcatgttccaccacgacctcatggaaaaggaatcatccacaatccacatagacgacatgtcgagagaatcttgcatggctctactaagttacctctacggaaacataacccaagaagagttctggaaacacaggctcgccctcctcggcgctgcaaacaagtacgacataacggatttgaaagcagcctgcgaggagagcctaatggaagatataaactcgagtaatgtgctcgagaggctacaagaagcttggctttatcagctggagaaactgaagaaagggtgtttgatgtatttgtttgatttcggaaagatttatgatgtcagagaagaaatcagcagtttcttcaggcaagctgatcgagaactgatgctggagatgtttcaagaggttttgtctgtgtggaaaccggtctaatatacacttacacacatactttgaacatttcagcttgatggtgttttgtttatagtcttcttgttctcttctgtgtgtgtaactaacaacaactctggattttgttgtatcactctgtctaatgtatagtattgagtggatttgcctct

SEQ ID NO: 139 - DNA, 1252 bp, Brassica oleracea
ggcacgcgtccgcagaggagcgcggctacgaaaccgctctcgaattcgttttttcattcggaacatcacccaattctctagcaatttcccatgacttcagatgctctcaacataccatccgagcttgaatctgcgttacggctcaggaccgtacaatactttatcacaaagaggccttggcttgatctctatggagtccatgtaaggcccgtggcaccattcggaagcacaagcagtaaaccacagttcgatccagcattgatccatcgttccttgcctgatgagcttcttttcgaggtgtttgctcggatgttgccttatgaccttggcagagcagcttgtgtctgcagaaagtggaggtacactgttcgcaaccctgtcttctggcgtaacgcgtgcttgaaagcttggcagactgctggagttatcgaaaactataggatcttgcagtctaaatacgatggatcatggaggaaaatgtggcttcttagatccagagttcgtactgacggtatttatgtgagtagaaacacttacattcgagctggaattgctgagtggaagattacaaatccagttcacattgtatgttacttccgctacataagattctacccttctggcaggtttctttacaagaactcttcgcagaagctgaaggatgttgccaaatacatgaactttaagtcttctaaagcagacggtctttacagaggcacttacacattgtcaatgacagatgacaagatcgaagcagctgttctgtatccagggacgctccctactgtcttaaggatccgtttaaggttaagaggaacggcgattggagccaataacaggatggatttgctgtcactagtgacgagtggtgtgaacgacgaggaaggaagtagcacagaagaggacattcttggggtagttgagaattggagagacgacgagactcacaatccggatatacctgccgtctcacacaagaggggtatgactcccttcrtcttcgtcccgttcgaagaggttgaacaatcggtcttgaacttacctccagagaaaatggattactttgtmaccggctagagtgacacatcaaccaacgcctatctcaatgtacaaagaacataatatatcaatgtagaatataatgtttgcatgtttggtttgattattatgactacaacattgctagtgtctctgtttgttgctgttacacgccaaatgttgacactctgttgtttatataaacatgaaagaa

SEQ ID NO: 140 - DNA, 1807 bp, Brassica rapa
accgaaccttgaaacgtcggtttccatgtgaataatgtgmscyttgktcgagacaacgcgaaaataaaaaaaaagtctctggtcttgatcttaatcttatcgtcctgtttcttaaatttttccggtaacagaggagcgcggctacgaaaccgctctcgaattcctttttcattcggaacatcacccaattctctagcaatttccacatgacttcagatgctctcaacataccatccgagcttgaatctgcgttacggctcaggacggtacagtactttatcacaaagaggccttggcttgatctctatggagtccatgtaaggcccgtggcaccattcggaagcacaagcagtaaaccacaatttgatcctgctttgattcatcgctccttgcctgatgagcttcttttcgaggtgtttgctcggatgttgccttatgaccttggcagagcagcttgtgtctgcagaaagtggaggtacactgttcgcaaccctgtcttctggcgtaacgcctgcttgaaagcttggcagactgctggggttatcgaaaactataggatcttgcagtctaaatacgatggatcatggaggaaaatgtggcttcttagatccagagttcgtactgatggtatttatgtgagtaggaacacttacattcgagctggaattgcggagtggaagattacaaatccagttcacattgtatgttacttccgttacataagattctacccttctggtagatttctttacaagaactcttcgcagaaactgaaggatgttgccaaatacatgaactttaagtcttctaaagcagacggtctttacagaggcacttacmcattgtcaatgacagatgacaagatcgaagcagctgttctgtatccagggacgcgccctactgtcttaaggatccgtttaaggttaagaggaacggcgataggagcaaataacaggatggatttgctgtcactagtgacgagtggtgtgaacgatgaggaaggaagtagcacagaagaagacattcttggggtagttgaaattggagagacgatgaaactcacaacccggatatacctgccgtctcacacaagaggggtatgactcccttcgtcttcgtcccgttcgaagaggttgaacaatcggtcttgaacttacctccagagaaaatggattactttgtcaccggctagagtgacgcatcgcatcaacgcctatctcaatgtacaaagaagatgatatatcaatgtagaatataatgtttgcatgctttatttgattattatgactacaacattactactagtgtgtctgtttgttgctgttacaaggcgcagtgtgacattttgttgtttacatataaacatgcaagaagctttaataatgtaatgttttatgttttattcaacaaacgcaaagcaagagagcttgatcagatgctagatttgaggagcttggactcctctgtgtaaaccagatgcttccaagacgggtttcgaggaagaaacgtttcggaaacgtaggagcaagtgggcacgatggagaaagagcgtgaggaggcgtgttcgaaggcagcgacgcagagatgcgaagctaaacccaatcctcctttagacgacggcacgtaagttcgaaccaagtccatgacagtcccgttgttcatcatcttgtattcaatgaaagcttcgtggtcctccgtctcgaatctatgcctcccttcgttccacwcaatcttcggtttattctccgtcgccatttctgaactttcacctcggccgcgaacacgcttaatcactagtgaatttcgc

SEQ ID NO: 141 - DNA, 1569 bp, Gossypium hirsutum
attttttatttccttctaattttgaaatatcggggtttggtaaatttawaaagaggagagaagatttccttcaattttcctttgaggttcataaaattcatagttgattcgattcccatgaatccagttccctctgaagtagaattagaatcagctttgcgcttgaagaccgtacagtactttgtgacgcagaggccttggcttgatctttatggaaaacatgttagaccagttgccccttttggaagcgccagcagaagatcatatgttgatcctgcacttatccatcgtagcttgcccgatgagctgcttttcgaagtctttgtacgaatggctccatatgatttaggaagggcatcatgtgtttgtcgaaaatggaggtacacaatccgtaaccctgtgttttggcgtacagcctgcttaaaggcttggcagctttctggcctggtggagaattataagatcttgcaatcaaaatatgaaggttcatggaggaaaatgtggcttttaagacctcgggtacgaactgatggtctctacgtaagtcggaatacttatattcgtgctggagttgcagagtggaagatcacaaatccagttcacattgtctgctactttcgttacttgagattttttccttctggcagatttctatacaagaattcctctcaaaaaataaaggatgcagcaaagttcatgaattttcgtgcatccaaagcagactgtgtttttggtggccattacactttgtccgataacaaggttgaagctgccgtcttgtaccctggcatgcgtcctactgtgttgagaattcgtttaagattacgaggaacaacagcaggggctaacaatcgaatggatttactttcccttgttactagtggtgtggatgataatgaagccagtggtcctgaagaggacatccttggagttgtcgaaggctggcaggacgatgaaactcacaacccagatgtgcctgctgtgtcccacaaaaggggtctaacaccatttgtctttgtcccatttgaagaggtggaaacatccgatttaaatctgcctgtggaaaagatggattactatgtcccgggctgagacttccagcttcagcaatcaagaatatcgcatttgtaaatatagatgtatcagttggaattaatagtatttctttattacataaaatacacctctgttcatgggattataagttgctcttaatcttttccatgaatcacaaactcataatgggtgtgcttttttggcattttatccatgatatgccatgtaatatattaccaatgtaatttgtagtggctgcaaataatttggcaccttaccaactccagatttaatccgttaattaaataattttgcaaaggtgaatttgttgtgaagtccatatataaaagcgtattttatccataagattctttaggttgggacgttgtaattttctcccggtataagagagtagtgggtggtagagtttttggtcgaccctttaaattttaattttagagtgtggtgcgatgtgtttaatttatcttttatcttatgttgtaatatcattcc

SEQ ID NO: 142 - DNA, 1251 bp, Arachis hypogaea
atttcgcccttcttcacaaattcgtggaatcgtcctcactctcatgtttctatggcctcaagttcagattttgcgttatcagttccttctgaacttgagtcagttttgaggttgaggactgttgattactttattacgaggaggccatggcttgatctttatggagttaatgtgagacctgtggcgccatttggaagtgcaagtagaaagccttatgtggaatctgcactcattcaccaatgcttaccagatgagctgctttttgaggtctttgctcgaatgactccatatgacttgggaaaggcatcttgtgtgtgtcgaaaatggaggtacacaattcgtaaccctgtattttggcgcgttgcatgcttgaaggcttggcagctctctggagtggtagaaaactataggattcttcaatcaaaatatgatggctcatggcgtaaaatgtggctctcacgaccaaggttgcgaactgatggtatttatgtgagtagaaatacctacattcgagccggagttgcagagtggaaaattactaatccagttcatctggtctgctatttccggtacatgagatttttcccttctgggcgatttctttataagaattcttctcaaaagatcaaggatgtggtgaagttcatgaactttcgatcatctaaagtagactctgtttttggtggccactacacattrtcagatgacaaggttgaagctgctgtcttgtatccaggcatgcgacctactgtcttgagaattcgcttgagagttagaggaacaactccaggggccaacaatcggatggatttgatttcacttgtcaccagtggtgtgaacaatagtgaggcaagtgcacccgaggaggacattcttggtgtagttgaaggatggcgggatgatgaaacacacaacccagatgtgcctgcagtctcacataagaggggcatgactccttttgtctttgttccatttgaccaggtggagacatcagtgttcaatcttcctgtggaaaaaatggattattatgtacctggttgaatggtgctgctgcataacaggcttggttcatttgtaaatattccttttgttccaatgctaaggttatgggaatttatatgtacatatgatgacaatggtcagggtctgagggattgattcttgatctgcgctgtggaatgatacttttgttctgctttatgcacttatatggaatgttattacccttaaaawaccggtttgtacagaaca

SEQ ID NO: 143 - DNA, 1736 bp, Raphanus sativus
ggctrgayrwsasstwrraramgamamrraaaaaaawaaaaawagtctctggtcttaatcttatcgtcytgtttttaattttccggtaacagaggcgcgcggctacgaaaccgcyctcgactttttcattcggaacaycycaattctctatcaatttcccatgacttcagatgctctcaacataccatctgagcttgaatctgcgttacggctcaggactgttcaatactttattacaaagagaccttggcttgatctctatggagtccatgtacggcccgttgcaccattcggaagcacaagcagtaaaccacaatttgatcctgctttgattcatcgttccttgcccgatgagcttcttttcgaggtatttgctcggatgttgccttatgacttaggaagagcagcttgtgtctgcagaaagtggaggtacacagttcgaaaccctgtcttctggcgtaacgcgtgcttgaaagcttggcagactgctggggttatcgaaaactataggatcttgcagtctaaatacgatggatcrtggaggaaaatgtggcttcttagatccagagttcgtactgatggtatttatgtgagtaggaacacttacattcgagctggaattgcggagtggaagattacaaatccagttcacattgtatgttacttccgctacataagattctacccttctggcagattcctttacaagaactcttcacagaaattgaaggatgtagccaaatacatgaactttaagtcttctaaaacagatggtctttacagaggcacttatacattgtctatgtcagatgacaagatygaagcagctgttctgtatccagggacacgccctactgtcttaaggatccgtttaaggttaagaggaacggcgataggagcgaataacaggatggatttgctgtcactagtgacgagtggtgtgaacgatgaggaaggaagtagcacagaagaggacattcttggggtagttgagaattggagagacgatgaaactcacaatcccgatatacctgccgtctcgcacaagaggggtatgactcccttcgtcttcgttcctttcgaagaggttgarcaatcggtcttgaacttacctccrgagaagatggattactttgtcaccggctagagtgacacatcaacgccgcctatctcaatgtacaaagaacataatatatcaaaatgtagaatatataatgtttgcatgttttatttgatttattatatgacaacaacaacactactagcatgtctgtttgttgctgctgttacaagcgctatgtgacattttgttgtttacataaacatgcaagaaaggcttaataatgtmatgtttttattcaccaaaagctttcgtacgaagtagatcagaggctagatttgaggatcttggactcctctgagtaaaccagatgcttccaagacgggtttcgaggaagaaacgtttcggaaacgtaggagcaagtggggacgatggagaaagagcgagaggacgcgtgttcgaaggcagcgacgcagagatgcgaagccaaacccaatcctgctttagaagacggcacgtaagttcgaaccaagtccataacagtcccgttgttcatcatcttgtattcaatgaaagcttcttgatcctccgtctcgaatctatgtctcccttcgttccacacaatcttcggtttattctcagtcgccatttctgaactttctcacttcttccatcc

SEQ ID NO: 144 - DNA, 1432 bp, Glycine max
tacgtcgatacggcagcgttttgaggtattctgcaattgttaccgaactcattccccttttttccgtcgttcttctcaatttgtctgagaaattcgtgaaggaacctcactctgttgctgcattcccccatggcttctgcttcagattttgcgttagcggtttcttctgaactcgagtcagttttgaggctgaagactgttaactactttgttacgaggaggccatggctcgatctttatggagttaacgtgagacctgttgcgcctgttgggagtgcaagtaggaggccttacgtggatcctgcacttatacatcgttccttacctgatgagctgctttttgaggtttttgctcgaatgactccatatgatttggggaaggcatcttgtgtttgtcgaaaatggaagtacacaattcgtaaccctgtattttggcgcaatgcatgcttgaaggcttggcagctatttggaattgtagaaaactataagatacttcaatcaaaatatgatggctcatggcggaaaatgtggctgttacgaccaaggttgcggactgatggtctttatgtgagtagaaatacttacattcgagctggagttgctgagtggaaaatcactaatcccgtacatgtggtctgctatttccgatacttgagattttttccatctgggcgattcctttacaagaattcatctcagaagatcaaggatgtggcaaagtgcatgaatttccgatcatctaaaatagactgtgtttttggtggccactacacattgtcagatgacaaggttgaagctgcagtcttgtatccaggcatgcgacccactgttttgaggatacgtttaaggttaaggggaacaacaacaggggctaacaatcggatggatttgatctcacttgtcactagtggtgtaaacagtagtgaggcaagtgcacccgaggaggacattcttggagttgttgaaggatggcaggatgatgaaacacacaacccagatgtaccagctgtctcacataagaggggcatgactccctttgtctttgttccatttgaagaggtggagacatctgttctgaatcttccggtggagaagatggattattttgtacctggttgaattattatgatgcctcagaatagaattggtccattgtaaataatccataacttaaggtcgtagtcgtagaatttgtaaatttatttatttgtatgtttatgtgtaagtatggcgtgatgagattgatttggttcgagttgcggaattatccctttattctgctttatgcatctggataacgggaataatcgtaatttttgttttgcaaatcatggattcgtttgttgaggacatgtagtaataaaactatataagaattgtgtaagatgtgtataacgtctttatatacgaattgggtgataaattagaaatg

SEQ ID NO: 145 - DNA, 1054 bp, Glycine max
ttcgtcgttcttctccatttgtctgagaaattcgtgaaggaacctcactctgttgctgcattcccccatggcttctggttcagattttgcgttagcggtttcttctgaactcgagtcagttttgaggctggagactgttaactactttgttacgaggaggccatggcttgatctttatggagttaacgtgagacctgttgcgccagttgggagtgctagtaggaggccttatgtggatcctgcacttatacatcgttccttacctgatgagctgctttttgaggtttttgctcgaatgactccatatgacttggggagggcatcttgtgtatgtcgaaaatggaagtacacaattcgtaaccctgtattttggcgcaatgcatgcttgaaggcttggcagctatctggaattgttgaaaactataggatacttcaatcaaaatatgatgggtcttggcggaaaatgtggctgtcacgaccaaggttacggactgatggtctttatgtgagtagaaatacctacattcgagctggagttgctgagtggaaaatcactaatcctgtacatgtggtctgctatttccgatacttgagattttttccatctgggcgattcctttacaagaattcatctcagaaggtcaaggatgtggcaaagtgcatgaatttccgttcatctaaagcagactgtgtttttggtggccactacacattgtcagatgacaaggttgaagctgcagtgttgtatccaggcatgcgacctactgttttgaggatacgcttaaggataaggggaacaacatcaggagctaacaataggatggatttgatctcacttgtcactagtggtgtaaacagtagtgaggcaagtgcacctgaggaggacattctgggagttgttgaaggatggcaagatgatgaaacacacaacccagatgtaccagctgtctcacataagaggggcatgactccctttgtctttgttccatttgaagaggtggaaacgtctgttttgaatcttccggtggagaaaatggattattttgtacctggt

SEQ ID NO: 146 - DNA, 3094 bp, Arabidopsis thaliana
aatgtggcttggcttatctcctcagcacaagtgtttcctctttactcttcaaatccttcttcattctcccattcacaattccttcatttttcatttttaacttatcctccatttttttttctgaaaacacacaaaaaaatatattcggttttagaattccaagaaatccgggaatgagcatatctctctagctagactcattccagcaaactctgaatcaatttcccattttcagatccaaatccattgtgttaaaaagagggattaacaaaattgaatagttcttaacaaacaattagaagaaaaaaaaagaggagaaacaaaatgaaagtggcagtgataggaagtggaataagtggattaggaagtgcttacgtacttgcgaatcaaggagttaaagaagttgtgttatacgagaaagaagagtcattaggaggtcatgctaaaacggtgcgtttcgatggcgttgacttggatcttggtttcatggtctttaatcgtgttacatatccaaacatgatggagttcttcgagaatcttggagtagagatggaggtttcagacatgtctttcgcagtgagccttgacaatgggaaaggttgtgaatggggaagccgcaacggtgtctcgggcttatttgctcagaagaagaacgttttaaatccgtatttctggcaaatgatcagagaaattgttagatttaaagaagacgtcttaaagtacattgaggagcttgagggtaaccccgatattgatcgaaaggaaacattaggagaatttctcaattcacgtggatactctgagttgtttcagcaagcttacttggtaccgatatgcggttcgatatggtcatgcccatcagacggtgtcttaagcttctctgcatactctgttctttcgttttgctgcaaccaccatcttcttcagatctttgggaggccacagtggctaactgttgcaggacgttctcagacttatgtcgcaaaggttaggacagaattggagagactaggatgcaggatcagaacaagctgcgacgtaaaatctgtttcgacatccgaaaatggttgtgtaactgttacaagtggagatgggtctaaagaagtattcgataggtgcatattggctatgcacgccccagatgctctgagattgcttggtgaagaagtaacgtttgacgaatctagggttcttggtgctttccaatacgtttacagcgatatatatctccatcacgacattgatttgatgccaaggaaccaagcagcgtggagtgcgtggaatttcttgggaagtacggaaaagaaagtatgtgtaacatactggctcaatatacttcagaaccttggcgagaacagtgaaccattctttgtaacacttaacccagacgagaccccaaagaaaacgttgctcaaatggaccactggtcaccctgtaccttcagttgctgcttggacagcttcacaagagcttcacaagattcaaggcaaacgtaacatatggttctgtggtgcatatcagggctatggtttccatgaagatggactaaaggctggtatggctgctgcacgaggtttgttaggcaaagaaactgctcttctgaacaatccgcgacatatggtcccttccttgacagaaacaggagctcggcttttcgttacaagattcttgggacaattcatatcaaccggttctgtaacaatactagaagaaggaggaacaatgttcacattcggagggaaggattctacttgtcctctaaaatctatcctcaagattcacagtcctcaattttactggaaggttatgacacaagcggatttaggacttgcagatgcttatatcaatggagatttttctttcgttgataaagaatcaggacttttaaatctgattatgattctcattgctaacagagatacaaaatcaaatcttagtaagaaaaggggatggtggacaccgatgtttttaactgcgggtttagcatctgcaaagtattttctaaagcatgtctctaggcagaacactctaacacaagctcgtagaaacatttctcgtcactatgaccttagcaacgagcttttcggtttcttcttggatgataccatgacttactcctctgcagtattcaagtcggatgatgaggatctgagaactgcacagatgagaaaaatctcgcttctgattgataaggcgagaatagagaaggaccacgaggttttagagataggatgtggatggggaactttggccatagaagttgtgagaagaactggatgcaaatacaccgggattacgctatctattgaacagcttaaatatgctgaagaaaaagtgaaagaagctggacttcaggactggattacttttgagctccgcgattatcgccaactatctgatgctcagaaatatgacagaattatatcttgcgagatgctagaagcggtcggacatgagttcatggagatgtttttcagtcgatgtgaagccgcacttgcagaaaatggcctaatagtcttgcagttcatatcgatacccgaagagcgttacaatgagtacagactaagttcagatttcattaaagaatacatattccctggtggatgccttccttctttagccagagtcactacagccatgtcctcttcttctaggctatgcatcgaacatgttgagaacattgggattcattactaccaaacattgagattgtggaggaagaacttcttggcgagacagaaacaaatcatggctcttggatttgatgacaaattcgtaaggacgtgggaatattattttgattattgcgcagctggattcaagactcttactcttggaaactaccagttggtgttctcgcgtccagggaacgtagctgcatttgcggattcatacagaggattcccttctgcttattgtgtcacctgagaggcatccacaacgtttgattgcttatatttttcgatctatacaatgtttgattgacctgaaatactagtattgattattgatttgtttggtgtgccaatttgtgaaagtttgttgaataaaagagagatttactttggaaaaaaataagcagtactcgtggagc

SEQ ID NO: 147 - DNA, 1781 bp, Arabidopsis thaliana
agaaaggaaaggaaagaaagaaaacaaaaggagtccaagaaaccagaagattgtctcccgacgccattatccttcaccctcggagcttttcttgaagcagggattcttctaatcattaatccctacttctttctttcttttttgtttgttctcctttgagatctatctagtactagtagtaaaaccccctcccctccattgaatttgaattgaattgaatctctgggaatcaaatctttgatgtcgcatctggacgacattccttctacgcctgggaaattcaagatgatggataaatcccccttcttcctgcaccgtactcgttggcaatcctccgtcgccaagcttgccttttggtcccttgtctttttcggattgctcttcatcttcttctaccgatctcccatctccaatcccgattcctctcgccgctctcttcgcacctactcttggggcggtcccgcctgggagaaacgcgtccgatcctccgctcgtgtccgcacccgcaacggcgtctccgttctcgtcaccggggccgccggtttcgtcgggactcacgtctctgccgctcttaaacgacgcggcgacggcgttctaggcctcgacaacttcaacgattactacgacacctctctcaagagatctcgacaagccctcctcgagagaagcggagtgttcatcgttgaaggagacatcaacgatctgtctctcctcaagaagctcttcgaggtcgtccctttcactcacgtcatgcatcttgccgctcaagctggtgtcagatacgccatggagaaccccggctcctacgttcacagcaacatcgctggtttcgttaacctcctcgaggtctgtaaatccgctaatcctcagccggcgatcgtgtgggcatcgtctagctccgtctacggtttaaacaccaaagtccccttctctgagaaagacagaacagatcagcctgcgagtctctacgctgcgaccaagaaagctggagaagagattgcccacacttacaaccacatctacgggctctctctcaccggcttgaggtttttcacggtgtacgggccgtggggaagacctgacatggcttacttcttcttcaccagagacatcctcaaagggaaagctatttcgatcttcgaaggagccaatcacggaacagtggctagggatttcacatacatcgatgacatagtgaaaggatgtttgggggctctggacacggcggagaagagcacagggagtggtggcaagaagcggggagcggctcagctaagggtattcaacctggggaacacatctccggtgccggtgacggatcttgtgagtatattggagagattgttgaaagtgaaagccaagaggaacatgatgaagctgccgaggaatggtgatgtgcccttcacacatgctaatatcagttcggcacagagagagtttgggtacaaaccaagcacggatttgcagactggtctaaagaagtttgtgagatggtatcttggttactacaagcaggggggaaagaaagttgctgctgctgcttgaatattgataattcacaagattctttagtgtatagtgagtgagtggattgatacacaccataaagaagagacatgattcattcgagattatatattctttacatttgtattctgctttgtaatttcgatctcttgagtcgaatctctgatatttatttcataggaagttcacattaatctctgttattcaaccgatggagccagagagagtaatgaatatgatatatacattatgct

SEQ ID NO: 148 - DNA, 1448 bp, Arabidopsis thaliana
gtggcatcttaatcaaattcttcttcgccttcactttcaattgtctctccaatatcctcaccagatctgaaaccggcaccggcgacgtgtttccgaggttaaacactctcaattgcgccggacctctcttcttccctccactccctgtactcttctccgccgtatctagcgccgctaaacatcccttcactatatcgtctatgtaagtgaaatccctagccaccgttccgtgattcgccgattcgaatatcgaaatcgatttgccttttagaatatctttagtgaagaagaaatacgccatgtctggtcttccccaaggtccatacacggtgaaaaatcttaatccggttagagataatccatagatgtggttgtaggtatgtgcgatctcttcgccggcttttttagtggcggcgtataaactcgccggttgatctgttttatctttctccgagaacggaactttggtgttgagtccgtagacggagctagacgaagcccagactatagcaggttgtggattcacagatttgcagatctcgaggagattgacgaatccggcgatgttgctatgaacgtacgagctagggttttccattgcgtaccgtacaccagcttgagctgctaaatgcataacgtgtgtgaaggagacgatcttgaatagcttacggagtaattcgacgtcgtttatgtctccttctacgatgaagatcccacttctctcgagtaaagctcgtcttgctcgtttcagagatggatcgtagtaatcgttgaagttgtcgaggccgattacgccgtctccgcggcgttttaatgcggcggagacgtgtgttccgacgaaaccagctgctccggttactaaaactgtgattccgttgtttgttgaggttcggattcgagctgaggatctgagacgtttttcccaagctggtcctccgtaggtgttggttcggagtgaacggcgagatggatcggacggtgaagaagggttaatggacggtggagatcggaggaagagtagagagatgagacagaggaggaagaaggagaaaaatgcaaactttgtgagagaagattggaatctgagacgatgcaagtaggaagatttctccatcttgaatttgcctgggcttgaagaacatggggattgaagattttagagatccaaatcatagggaaaatatgaagaagaagaagaagaagaagaagaagaagaagaagaagaagaagaagaagagagtcaaaaaaattactgtaaaaatttgttgactcttctaaagatttgttgtcgagtcttgaaatttgattggtgagatactaatactccaagattttcgggaagccactcgtcccaaaagttttgaatttgaaccaaagttttaaacttttgttaatagatttgttttgcggatagttgctaaatacaaaaatggactctaaatttgaat

SEQ ID NO: 149 - DNA, 1687 bp, Arabidopsis thaliana
gcattttcgagagaaaaagaaataaagaaggcccaaaaatagagaaacaaaaatcttttcaatttgatgatcttcccttattattcggagagcctataaacgctctcaccaaacaaaccaaaaccaaaaccaatccaagaaaaaaaagaaacctcaaagaagaagaagaagaagattctctctgtcgaggtaaatatgaagcaaatgtcgcatcttgatgatattccttcgacgcctggcaagttcaagccctacttccaccgtacgcggtggcaatcctccgtcgccaagctcgccttttggtctctcgtcttcgttggtttgatcttcatcttcttctaccgatctcccgtttcctccaatcccgccgatccttctcgccgttctcttcgtacctactcctggggtggacccgcttgggagaaacgggtcagatcctccgcccgtctccgtacccgccgcggtttctctgttctcgtcaccggagccgccggtttcgtcggtacccatgtctccgccgctctcaaacgccgcggagatggcgttctggggcttgacaacttcaacgattactacgatccatcgctcaagagagcaaggcaagcccttttggagagaagcggagtgtttgttgttgaaggagacatcaatgacgctgctctcttgaagaagctctttgaagttgttccctttacccacgttatgcatttggctgctcaagctggtgtcaggtacgccatggaaaatcctagctcttatgttcacagtaacatcgctggcttcgtcaatctccttgaggtttgcaaatctgccaatccccaacccgccattgtctgggcttcctctagctctgtctacgggctcaacactaaggtccccttctccgagaaagacagaactgaccaaccagctagtctctatgctgctactaagaaggctggtgaagagattgctcacacttacaatcacatctatggactctctcttactggcttgaggtttttcaccgtctatggtccttggggaaggcctgacatggcctatttcttcttcaccagagacattctcaaagggaaagccatttcaatctttgagggggtcaaccatggaaccgtggctagggacttcacttacattgatgacattgtcaaggggtgtttaggggctttggacacggctgagaagagcactggtagtggtggtaagaagcgcggtgcggctcagttacgggttttcaatctcggcaacacttcgcccgttccagtgactgatcttgtcaccattcttgagagacttctcaaagtcaaggccaagaggaacattatgaagttgccgaggaacggggatgtgcagttcactcatgctaatatcagttctgcgcagagagagctcggctacaaacccaccaccgatcttcagacgggtctcaagaagtttgcgagatggtatttgggttactacaatggcggaaagaaagctgcaagctgatgattgactatctgcaatgagtttgtagcctctctttttttttttgattctgagattcttgtgattgtttcactctttaacacttgctctttttgttggttctttggccggctcataccctgtctttgccgtatatgtttttactcaaaaccatttatactccataagaaccattatttcgggattacattctttgtca

SEQ ID NO: 150 - DNA, 1637 bp, Brassica rapa
aaacaaaacaaaccccaaaaaaaaaaatcaagaaaatggaataatagatagcctccaaaggaaagaaagctcaagattctcgggacgacattatcgcctgctttgtagatctttcaatttcaatttcaatttgagtgtgatcttgaaagtggtaaaatattgaagatgaagcatctggatgaaactccgtcgacgccgggcaagttcaagatggataaatctccatacttccttcaccgcacgcggtggcaatcatcggtggcaaagctggccttctggtctctggtcttcgtcggcttcatcttcatcttcttctaccgatctccctcctcccttcccgatccatctcgccgctcccttcgcacctactcctggggaggccccgcttgggagaagcgtgtcagatcctccgcccatgtccgcacccgccgcggtgtctctgttctcgtcaccggcgccgccggattcgtgggcacccatgtctcggcggccttgaaaagacgcggggacggcgttctggggctggacaacttcaacgattactacgatccgtcgctcaagagagcgaggcaagccctcctggagcggagcggggtgttcgtggtggaaggagacatcaacgacgcggcgctcctcaagaagctcttcgaggtggtccctttcacccacgttatgcatttggccgctcaagccggcgtcaggtacgccatggaaaaccccagctcctacgttcacagcaacatcgctggcttcgtcaatctcctcgaggtctgtaaatctgctaacccccagcctgccatcgtctgggcctcctctagctccgtctacggattgaacaccaaagtccctttctccgagaaagaccgcaccgaccaacctgctagcctctacgctgctactaagaaagccggcgaagagatkgctcacacttacaaccacatctatggcctctctctcaccggtttgcgcttcttcacggtctacggtccctggggaagacctgacatggcctacttcttcttcaccagagacattctcaagggcaaacccatttctgtcttccaaggcgccaaccacggcactgtcgctagggacttcacctacatcgatgacattgtcaagggctgtttgggggctttggacaccgccgagaagagcactgggagtggtggcaagaagcgtggtgccgctcagttgagggttttcaatctcggaaacacctccccggttccagtgactgatctggtgactattctcgagaggttgttgaaagtcaaggcaaagaggaacattgtgaagatgcctaggaatggcgatgtgcccttcactcatgctaacatcagttccgcgcaaagagagctcggttacaagcccaccaccgatcttcagactggtcttaagaagtttgccagatggtatttgggttactacaatggcggaaagaaagctgcaagctgatttttattgattgattgatcctcctctttgtgtttgttgtagctgtgtaagcaagcccctcttcttttttctgattcgagattcttgtgattgtttccacttgctcctcctccttttgttggtcctttgtcttctccgtatatgtttttaagcatccatttatactccacgagaaccat

SEQ ID NO: 151 - DNA, 1674 bp, Brassica napus
caaaccccaaaaaaaaaatcaagaaaatkgaataatagatagcctccaaaggaaagaaagctcaagattctcgggacgacattatcgcctgctttgtagatctttcaatttcaatttcaatttgagtgtgatcttgaaagtggtaaaatattgaagatgaagcatctggatgaaactccgtcgacgccgggcaagttcaagatggataaatctccatacttccttcaccgcacgcggtggcaatcatcggtggcaaagctggccttctggtctctggtcttcgtcggcttcatcttcatcttcttctaccgatctccctcctcccttcccgatccatctcgccgctcccttcgcacctactcctggggaggccccgcttgggagaagcgtgtcagatcctccgcccatgtccgcacccgccgcggtgtctctgttctcgtcaccggcgccgccggattcgtgggcacccatgtctcggcggccttgaaaagacgcggggacggcgttctggggctggacaacttcaacgattactacgatccgtcgctcaagagagcgaggcaagccctcctggagcggagcggggtgttcgtggtggaaggagacatcaacgacgcggcgctcctcaagaagctcttcgaggtggtccctttcacccacgttatgcatttggccgctcaagccggcgtcaggtacgccatggaaaaccccagctcctacgttcacagcaacatcgctggcttcgtcaatctcctcgaggtctgtaaatctgctaacccccagcctgccatcgtctgggcctcctctagctccgtctacggattgaacaccaaagtccctttctccgagaaagaccgcaccgaccaacctgctagcctctacgctgctactaagaaagccggcgaagagattgctcacacttacaaccacatctatggcctctctctcaccggtttgcgcttcttcacggtctacggcccctggggaagacctgacatggcctacttcttcttcaccagagacattctcaagggcaaacccatttctgtcttccaaggcgccaaccacggcactgtcgctagggacttcacctacatcgatgacattgtcaagggctgtttgggggctttggacaccgccgagaagagcactgggagtggtggcaagaagcgtggtgccgctcagttgagggttttcaatctcggaaacacctccccggttccagtgactgatctggtgactattctcgagaggttgttgaaagtcaaggcaaagaggaacattgtgaagatgcctaggaatggcgatgtgcccttcactcatgctaacatcagttccgcgcaaagagagctcggttacaagcccaccaccgatcttcagactggtcttaagaagtttgccagatggtatttgggttactacaatggcggaaagaaagctgcaagctgatttttattgattgattgatcctcctctttgtgtttgttgtagctgtgtaagcaagcccctcttcttttttctgattcgagattcttgtgattgtttccacttgctcctcctccttttgttggtcctttgtcttctccgtatatgtttttaagcatccatttatactccacgagaaccataaactgagatatatcctcctgcactatatttcgttttacttatttg

SEQ ID NO: 152 - DNA, 2071 bp, Citrus sinensis
taatcacagttctataactctggccttccttgatctccattacccaagttttaaaattctctctataaaaacaaaatcaaaacttggtcttttgaataacaatagaacccaatacaatatagatcatagatagagcgaagcaaaggagagcaaatcaacccattcccccagcaaacaagaagaaggttcccatttcccattttgctcacaaggacatgagagcttaaaacaaacaacaaaaaaccctttggccttcactatccttatcttcaaaacaaaccctaaccctaaaatcaaaaagaaaaaaagaaaaaaaaaaaactcgcaaatgtcacagctaaaacaaatgtcccatcttgataacattccctcaactcctggcaaattcaagatggacaaatccccatattttaacagactccgattccattcttctttagcaaagctcacattttggtccttcattttcttagccgtaatcttgattttcttctttagatccccatcgtccaatcctctaccctctgccgatccatctcgccgttcacttcgcacttacgactggggtggccccgcttttgagaaacgggtcaggtcgtcggcccgggtcagggccagaaatggcatctctgttttggtcactggtgccgctggttttgtgggcacccacgtgtcagctgccctcaaaaggcgcggtgatggtgttcttggtcttgataatttcaatgactattatgacccttctttgaagaaagcaaggcaagcgcttttggagcgaagtggaatttttatcgttgaaggtgatataaatgacatggctcttttgaagaaactcttcgatgtcgtgtcttttacgcacgtgatgcatttggctgcacaagctggtgtgaggtatgccatgcagaatcctaattcttatgtgcacagtaacattgctggtcttgttagtttacttgaagtttgtaaaaatgcgaatccgcaacctgctattgtgtgggcgagttctagttctgtttacgggcttaataccaaggtgccatttagtgaaaaagatagaactgatcagcctgctagtttatatgctgctactaaaaaagccggtgaagagattgcacatacttataatcacatttatggattatctttgactgggttgaggtttttcactgtttatggaccttggggtaggccagatatggcatatttcttttttaccagggacattttgaatcggaaatcgattccgatatttgagtctcctgaccatggcacggttgctagggattttacctacattgatgatattgtgaagggttgtttagcagcattggacactgcagagaagagtacaggaagtggggggaagaagaggggacgagcgcaattgagggttttcaatttggggaacacttctcctgtaccagtttcagatcttgtgagtattttggagaggcttttgaaggttaaggccaagagaaatattatgaagttgccgagaaatggtgatgttccgtttactcatgcgaatattagtttggctcagagagaactggggtataagccgacaacagatctgcagacagggctgaagaagtttgtgcggtggtacctcagttactacgctggtggaaagaaggctgctggttgatctgttcttttgattgtgtggtaggatcctttgagttcttgttcgtcatgcttcttatgattgttttttaacatttctttgttccttgtccaattactgttcatctttcatatatttctgatgatgccaatatgaggaacatcaagttctactgcgttggagaagtttttatggttggtgaacattatttgctggccagtcccgggtgtattaaagaaagccagaacctttgttttttttaatttttccctttttttaccccttctggaatgtaattgttgtagtttcagcattgtagaattcatgactcatagaacatctgctgattgttggacatgtatcattgccatgcaattcaataaaagagcacacgtactaggtaaattcaattacatttaactgcttgattacctaattcctttt

SEQ ID NO: 153 - DNA, 1850 bp, Glycine max
atgtcgcacatagacagtgcccctccgaccccagggaagttcaagatggataaagcttcgtacttcaaccgcgtgcggtggcacacctcgctggcgaagctcgcagtgtggtccttcgtgttcctgggcgcgatcttgatctttttcctccgctcgccggcatcgtctccggtcccggcggacctctcccggcggtccctgcgaacctacaactggggcggacccgtttgggagaaacgggtccgggcatccgcccaggtccggtcccgaaacgggttcgccgtgttggtcaccggcgccgccggttttgtaggcacccacgtctccgcggcgcttaagcgccgcggtgacggggtgcttggacttgacaatttcaatgactattatgacccttcacttaagcgtgcacgccaggggctcctggagcgcaatggcgtgtacatagttgagggtgatatcaatgatgaggcactcttgagaaaacttttcgaggttgtgcctttcactcatgtgatgcacttggctgctcaggctggtgtgaggtatgccatggagaatcctggctcttatgttcatagcaacattgctggttttgtgaatttgcttgaggtttgtaagagtgtgaatccacaacctgctattgtgtgggcctctagtagctcagtttatggactcaacactaaggttccattctctgagagggataggactgatcagcctgctagtttgtatgctgcaaccaagaaggctggtgaggagattgctcacacttataaccatatctatggtctttcattgactggattgaggttcttcactgtttatggtccttggggtaggcctgatatggcttacttcttcttcactagggatcttctgaaggggaagcccatccctattttcgaggccgcgaatcatggaaccgttgctagggattttacttacattgatgatattgtgaggggttgtttgggggctttggatactgcagagaagagcacggggagtggggggaagaagagggggccagcacagttgagggtgttcaatttggggaacacttcgccggttccggttagtgatctcgtgagcattttggagaggcttctgaaggttaaggcgaagaggaacataatgaagttgccgcggaatggggatgtgcagtttactcatgccaacattagctatgctcagagtgagcttgggtacaagccgaccacggatctgcagagtggtttgaagaaattcgtgcggtggtacctgaattactattctggcgggaagaaagctgttgagtgacctgattcttttaaccatgtgatattgtcttttgaattcttgttcattatgattcttgtgattgttccttagcgtttctctgttcgttgtacgatcaccgcgtttcatgtgtcaaggatgatgccatataaggaggaagaagtaggaaccttgcttcctgcactgaggaagttttgttgttgggggagattaatgcctaggcaccgatttgctgtgtccaagaaaaccagatacatcatattctcttttattctttttctttttcctgaatgtatttgttgtagttttagaaatgtagcattcatgactgatagagcatatgctgattggtggcagtgtataataattgttaagaaaaggtagtaaaatcacacaatagtttgatttccggtttttggactgaatgagtcaataagacatgtattttatttgcttatgtaatttttcacatataaatggactcctgtattaataattcttgcacagctctactactttgtgatcctattgctaacattttggaggtggctctgtggcaccctttcttctgt

SEQ ID NO: 154 - DNA, 1914 bp, Glycine max
caccattataatacactccctgcaaaccctagaaacccaataatttgggggaacctcaacccaatcccagaaaccaaaatcggcctcgcaatttaacgaaaccgaggaagagaaatcgtgggcacccttcaaaattcgagatttccccgacaaaatgtcccaactgaagccaatgtcgcatatagacagtgccccttcgaccccagggaagttcaagatggagaaagcttcgtacttcaaccgcgtgcggtggcacacctcgctggcgaagctcgcagtgtggtccttcgtattcctgggcgcgatcttgatctttttcctccggtcgccggcgtcgtcgccggttccggcggacctctcccggcggtctctgcggacctacaactggggcggacccgtctgggagaaacgggtccgggcctccgcccagatccgttcccgaaacgggttcgccgttttggtcaccggggccgccggtttcgtcggcacccatgtctccgcggccctcaaacgccgcggagacggggtgctgggacttgataatttcaatgactattatgacccttcactaaagcgtgcacgccagggactcttggagcgctctggggtgtacatagtggagggtgatatcaatgatgaagcactcttgaggaagctttttgaggttgtgcctttcactcatgtgatgcacttggctgctcaggctggtgtgaggtatgccatggagaatcctggctcttatgtgcatagcaacattgctggatttgtgaatttgcttgaggtttgtaagagtgtgaatccacaacctgctattgtgtgggcctctagtagctcagtttatggactcaacactaaggttccattctctgagagggataggactgatcagcctgctagtttgtatgctgcaactaagaaggctggtgaggagattgctcacacttataaccatatctatggtctttcattgactggcttgaggttcttcactgtttatggcccttggggtaggcctgatatggcttacttcttctttactagggatcttttgaaggggaagtccatccctatatttgaggccgcaaatcatggaaccgttgcgagggattttacttacattgatgatattgtgaggggttgtttgggggctttggatactgcagagaagagcacaggaagtggggggaagaagagggggccggcacagttgaggattttcaatttggggaacacttcgcctgttccagttagtgatcttgtgagcattttggagaggcttctgaaggttaaggcgaagaggaacataatgaagttgccgcggaatggggatgtgcagtttactcatgccaacattagctatgctcagatggagcttgggtacaagccgaccacggatctgcagagtggtttgaagaaattcgtgcggtggtacctgaattactattctggcgggaagaaagctgttgagtgactgattctttttaccatgtgataatgtctttgaattcttgttcattatgattcttgtgattgttccttagcgtttctctgttcgttgtacgatcaccgcgtttcatgtgtcaaggatgatgccatataaggaggaagtaggaaccttgtttcctgcactggggaagttttgttgttggtggagattaaggcccagaaaaccagatacatcatattctcttttattctttttttcttgaatgtaattgttgtagttttagaaatgtagcattcatgactgatagagcatatgctgattggtggcaatgtataataattgttaagaaatggtattaaaatcacacaatagtttgatttccggtttttggactgaatgagtcaataagacatgtattttatttgcttatgtaatttttcagctataaatggactcctgtattaata

SEQ ID NO: 155 - DNA, 1869 bp, Solanum lycopersicum
tacaataattacttgctactaccattttgttccaacaacaaccagtgcctccaagaaaccagaagattcccataaatataggctaaagtttcaatatcctcatcttcttttttgtttgtttgatgataccaataccctcatcatcaccttcatagccaccccttttcctttattttgcttcttatctccatttccactatcaacaaccaaaaggaaaacaaaaaagaagagacttttttttcaaaccctaactctcgcctttttcaagaaaatttggagatttcctttgaaaacaagaaatagtcaaggtgggtatagctcaaatatccaagatttggaaagtgtaatgtcccaaatgatgcacattgacaatatcccatcaaccccaggaaagttcaagatggaaaagtctccttacaataggctaaggatgcatttttctctagcaaagctcacattttggtcatttgtattcttggggttgatctttgtattcttctacagatctccagcttcttcgtcccctgtttcttcagatctctcaagaagatctctcagaaccagctcctacggtggccctgcttgggaaaaaaggatkaamgcttcagctaaagtaaggtcacgtaatggtatttctgtattggttactggtgctgctggctttgtaggaactcatgtttcagttgctcttaaacgccgtggcgatggcgtattgggtttggataatttcaatgattattatgacccttccctcaaaagagcacgacaagcgctcttagagcgaacaggggtgtatgttgttgagggtgatatcaatgatgccaccctcttgaagaaactttttgatattgttccatttactcatgtaatgcatttagctgcacaagcaggtgtgcgttatgccatggaaaatcctggatcatatgtgcatagtaacattgctggtcttgttaatgttcttgaaatttgtaaaagtgttaatcctcaacctgctattgtgtgggcatcatctagttctgtatatggattgaatactaaagtacctttttcagagaaggatagaacagatcagcctgctagtctttatgctgcaactaaaarggctggtgaagaaattgctcatacatataatcatatatatgggctttcattaactggattgagatttttcaccgtttacggaccatggggtaggccagacatggcttacttctttttcacagggatatcttgaagggaaaatcgattcctatattcgaggctgctaatcatggcacggtagctagggrwtttacctacattgatgatatagtgaaaggatgcttggcagcattggatactgctgagaagacactggaagtggtgggaagagaaagcgctgctcaactgcgggtgttcaatttaggcaacacatctcctgtgccagtttcagatcttgtaggcattttggagaggttgctaaaggtgaaggccaagagattggtgatgaagttgccaaggaatggggatgtgccttttactcatgccaatataagttcagcccacaaggagcttggatataagcctacgacggatctacagacgggattgaagaaatttgtccgatggtacctcaattactatggtaatggaaagaagagtgcccagtgatacattctttgaattgtgcggtaggatcattcaattcttgttcattttgattctatgattgttttttttcaacacatatccgatcaaattgccccactttcttgctttctaaatcttgatgatgccatatatggagcacatcasatccctctgatgatgaagttttgtgctgagcaatttgatctgtgtcmratggaacctgaaatcaacttttattac

SEQ ID NO: 156 - DNA, 641 bp, Brassica rapa
gggtcatcctcgtcggcatcatttctcaatctctccttcgccgccggactccgtcgcttacagtcttttgtagagtaagagagagagagagagaaagatggtgattccaccggcagtgagaccaccacgcctcttcgactacctcaaaccttacgtcctgaagatgcacttcacgaacaagttcgttcacgcccaagtcatccactcaccgacagccacagtggcttgcgcagctagctcacaggagaaagcactgagggaaacgatgggggtcacgcgcgacgtggctgctgcttcaaagattggtaagatcctcggggaaaggctcctgatgaaagatatcccagctgttgctatccacatgaagaaagagcagaggtatcatggtaaagtcaaggctgtgatcgattccgtcagggaagctggcgttaagttactttgagtattatttcaacaaacaatccatgaaaccaaaatcaatctcgtgttattcgtttcgaacattgttgttttttttttgtagcttatcagacagattgagatcagattggtggttttgtgcttatgttcatgtttgttcttcagcttcagggttatgaagaaacttgttctaaagagaactaatgttataagctttgact

SEQ ID NO: 157 - DNA, 559 bp, Brassica rapa
ggctcccagtctctcactctcccttcgccggactccgtcgcttcccatagacttttatagagtaagacagagagagagagactaggatggtgattccaccggcagtgagaccaccacgtctcttcaactacctcaaaccttacgtcctgaagatgcacttcacgaacaagtttgtccacgcccaagtcatccactcaccaacagccacagtagcttgctcagcgagctcgcaggagaaagcattgagggaaacaatggaagtcacacgcgacgtggctgctgcgtcaaagattggtagaatcctcggggaaagactcttgatcaaagatattccagctgttgctattcasatgaagaaagagcagaggtatcatggtaaagtcaaggctgtgattgattctgtcagggaagctggcgtcaagctgctttgaggatccatgaaaccaaatcaatttcatgttgttatttctgaacattgtcgtgtttttgtcggcttatctgacagattgtgatcagattggtgccacaatgaaagccttgcttaagttcatgttatgag

SEQ ID NO: 158 - DNA, 672 bp, Brassica napus
ggtcatcaatcatcatcctcgtcggcatcatttctcaatctctccttcgccgcyggactccgtcgctttctattttccagtcttttatagagtaagagagagagagagaaagatggtgattccactggcagttagaccaccacgcctcttcgactacctcaaaccttacgtcctgaagatgcacttcacgaacaagtttgttcacgcccaagtcatccactcaccgacagccacagtggcttgcgcagctagctcacaggagaaagcactgagggaaacgatgggcgtcacgcgcgacgtggctgctgcttcaaagattggtaagatcctcggggaaaggctcctgatgaaagatatcccagctgttgctatccacatgaagaaagagcagaggtatcatggtaaagtcaaggctgtgatcgattccgtcagggaagctggcgtcaagttactttgaggattatttcaacaaacaatccatgaaaccaaaatcaatctcgtgttattcgtttcgaacattgttgttttctttttgtagcttatgttcatgtttgttcttcagcttcagggttatgaagaaacttgttctaaagagaacgaatgttatataagctttgactattgaaacaataggactatatatcaatttcgtttctaaaatttttgacatat

SEQ ID NO: 159 - DNA, 719 bp, Brassica napus
atcaacgcagagtacgcgggggtttcactctctccttcgccggactccgtagcttcctatttttccagagtttcagagagtaaaagggagagaaagatggtgattccaccggcagtgagaccaccgcggctcttcgactacctcaaaccttacgtcttgaagttgcacttcacgaataagtttgttcacgcccaagtcatccactcaccaacagccacagtggcttgctcagctagctcacaggaaaaagcattgagggaaacaatgggggtcacacgcgacgtggctgctgctgcaaagatcggtaaactccttggagaaaggctcttgttgaaagacattccagctgttaccattcacatgaaaaaagagcagatgtatcatggtaaagtcaaggctgtgatcgattctgtcagggaagctggcgtcaagttgctttgaggattgttcaacgatccgtgaagccaaatcagtttcatatggttagttcggaacattgtcattctctttgtcttgagatcagagtggtgccataatgaaagcctttgcttagttcatgtctattcttctttcttttcttcagggctgtgaagaaaaatgttcaaaagagaatgaatttttatatgcttttgactattgaataataagattaatggttctttccgaataggagaagaatagttcaaagttgatttctttttcaccaatgaacaagctga

SEQ ID NO: 160 - DNA, 633 bp, Brassica napus
gggctcccagtctctcactctcccttcgccggactccgtcgcttcccatagacttttatagagtaagacagagagagagagactaggatggtgattccaccggcagtgagaccaccacgtctcttcaactacctcaaaccttacgtcctgaagatgcacttcacgaacaagtttgtccacgcccaagtcatccactcaccaacagccacagtagcttgctcagcgagctcgcaggagaaagcattgagggaaacaatggaagtcacacgcgacgtggctgctgcgtcaaagattggtagaatcctcggggaaagactcttgatcaaagatattccagctgttgctattcagatgaagaaagagcagaggtatcatggtaaagtcaaggctgtgattgattctgtcagggaagctggcgtcaagctgctttgaggatccatgaaaccaaatcaatttcatgttgttatttctgaacattgtcgtgtttttgtcggcttatctgacagattgtgatcagattggtgccacaatgaaagccttgcttaagttcatgttatgagctaagactattgaaataataagactttatacmaagcaataaaaccaaagtagacggagtctatacattcgggc

SEQ ID NO: 161 - DNA, 545 bp, Brassica napus
cctcgtcggcatcatttctcaatctctccttcgccgccggactccgtcgcttacagtcttttgtagagtgagagagaaagatggtgattccaccggcagttagaccaccacgcctcttcgactacctcaaaccttacgtcctgaagatgcacttcacgaacaagtttgttcacgcccaagtcatccactcaccgacagccacagtggcttgcgcagctagctcacaggagaaagcactgagggaaacgatgggtgtcacgcgcgacgtggctgctgcttcaatgattggtaagatcctcggggaaaggctcctgatgaaagatatcccagctgttgctatccacatgaagaaagagcagaggtatcatggtaaagtcaaggctgtgatcgattccgtcagggaagctggcgttaagttactttgagtattatttcaacaaacaatccatgaaaccwaaatcaatctcgtkttwttcktttcgaactwkttgttktttttttwagcwymwmwsasmsatykakmtcagmktsgwggttttgtgctt

SEQ ID NO: 162 - DNA, 649 bp, Manihot esculenta
tttcattttcctaacatcattaggatcccttatattgttcatgaatttcagttctttacttgtgattgtattgcctmctagcttgcagacagagaaatatggttattccaccgccagttaagtggccacctagagttagagagtttctgaaaccttatatcctgaagatgcatttcacaaacaaatttgtgagtgcccaagttatccactcgccatctgccacagtggcatgttctgcaagctcacaagagaaggccttaaggtcaagcatggagaatactcgagatgtagctgctgcagccaaaattgggaaaatactcggggagcggctgctgctcaaggacatacctgctgtttccattttcctgaaaagagaacagaggtatcatggaaaggtgaaagctgtgattgattctgtgagagaagctggtgtcaaactcctatgaattgttgttctaaagaattctactctgtcctgaatagattacttgcagagatgaacatttctacttttttcttggtcatgtcatggcaataaaaaagattgtatgttgatggatatttaatttgtttaatatttagttaggcaaataatcatgtagacttggattaacacagcaacttgaccttgtgctcatgtgatggagac

SEQ ID NO: 163 - DNA, 774 bp, Citrus sinensis
cacccacgcgtccgcctttttctcgacgccggaccatcaacgctgctactgaagaacccatatttatgagatggtaattcctccacctgttaggccacctaaactttccaactttctgaagccatatgtcctgaggatgcactttacgaacaagtatgtgagtgcgcaagtgatccactcaccaacagccacagtggcttcatctgcaacctcacaggagaaggccctgaggtcgagcatagggtgcactcgggatgtggcagctgcttccaagattgggaaaattctaggtgagcgacttcttctcaaggatatacctgctgttactgttttcttgaagagagaacaaagatatcatggtaaagtgaaagccgttattgattctctgagggaagctggtgtcaaattgctttagattcagcttaaagaattgtagttcctgctagttctttgctataaatgattgccgtctgttgatctatggaatgattgtgtggtgggatttgtgtttgtcatgttttgattgttttattttgaacagaattttagtgtgcatttacgacctagtttaagtgctttcagggaacttgtagaagtggttgtttttgttgaagaaggggattggattgaaatagttcttgctgtttcgaaattagaaataattgtatgttacttccttttcccattcctttcctttgtaccctatgatgcacacaaggtatatatgtgtcactttctgttttcttgtataaagttatcaggaaataagtgatt

SEQ ID NO: 164 - DNA, 1026 bp, Carica papaya
actacaagaatcggactgtgggtgatcgtcgctcgaaagggagaaagaaactaagacgactggaagtgaaagtgttcagatatggttattcctccaccagttaggccaccaaggattttacactttctcaaaccttatgtgctgaagatgcacttcacgaataagtttgtgcatgcccaagtaatccattcaccaactgcgacagtagcgtcttcagcaagttctcaggagaaagccttgaggggcagcatgggatctacacgagatgtggcagctgctgcaaagatcggaaagatacttggggagcggctattgcaaaatgacattcctgctgtttctgttttcttgaagagggagcagaagtatcatggcaaggtcaaagctgttattgattccttaaaggaagctggtgtcaagttgctctaagtatgtaataactcacccctaccatttttattccgggaggattgcaagacagttttctttaacatcttgagaaagagataagagtggtagtgtgtcgtctacgtaataactcgtccctaccatttttattctgggaatattgcgagacagttttcttttacatctcgagacagagatacacagtggtagtgcttcatctattccctagcgaaagaccttaccaaaatctgcaagagcttgtatggattttacgagctccaatgactacaaagaaaatattaagtccatgtttacatcaatctagttacttagcaactattttgttttaaattcaaccattttattatcgaattcgaaaaggagacaagtaaattgccaacctacgttatcttgttggaactcgtcttggaggtaagagataattcccgcacgggtgtatcaaatatccccctcaaagggggataattcccaccattttgtggggagtagcatcgaggataatcttggcaacacaagcaaccctcctattccctttgctcatagctttacttaatatggtttgtcaacatgaacattgactattcctatgttcatgttggt

SEQ ID NO: 165 - DNA, 637 bp, Raphanus sativus
ggctcgtcggcattttataatttcaatctctccttcgccgtcaggctccgccgctttcaatttctccagctaaaacttttatagagataaagagggagatggtgattccaccggcagttagaccaccacgcctcttcgactacctcaaaccttacgtcctgaaaatgcacttcacgaacaagtttgtccacgcccaagtcatccactcgccgacagccacagtggcttgctcagctagctcacaggagaaagcattgagggaaacgatgggcgtcacacgcgacgtggctgctgcttcgaagattggtaagatccttggggaaaggctcttgtcgaaagatatcccagctgttgctatccacatgaagaaagagcagaggtatcatggtaaagtcaaggccgtgatcgattccgtcagggaagctggcgtcaagttactctgagtattacaatccaaaaaaaatcaaattccaatgttgttgatttcggacattgtttgcttcttcatcttcagggttttgaagaaacctgttccaaaagagaatgaatgttaagctttggctattgaaataataggactatataatatcaaatttcatttctgaawattttgacatatagtgtcacagagagagag

SEQ ID NO: 166 - DNA, 502 bp, Raphanus sativus
ttytgttttccagacttccttttagagagagaattagaaagatggtgattccaccggcagtgaggccaccmcgtctcttcgactacctcaaaccttacgtcctgaagatgcrcttcacsaacaagtttgtccacgctcaagtcatccactcaccaacagcaacggtggcttgctcagctagctcacaggagaaagcattgagggaaacaatgaatgtcacacgcgacgtggctgctgcttcaaagatcggtaaactccttggtgaaaggctcttgatgaaagatattccagctgttactattcacatgaagaaagagcagatgtatcatggtaaagtcaaggctgtsatcgattctgtcagggaagctggcgtcaagttgctttgattattattcaacaacaatccttgataccaaattagtttcatgttcggaacattgttattctttttggattgagatcagagtggtgtcacatagaaagttataagcattgactattg

SEQ ID NO: 167 - DNA, 1527 bp, Brassica napus
gatcacarcttctttyacmttcsaarcgaaaggaggaagaagatgaagctaaaatgggaatcaatctctactcttcaccaaaacgtcttcctcgtcaaggtcctcgctgccgttttcataaccggtctcgccttccgcttctacgccgtccgcttcggccaagtgtcggtgaacgaaatctccgatcctcagatctctcctccttctgttatcatatcggagaacgaggatctcctccccatcgatattgaggtggagaagtgtgatctcttcacggggaaatggatcagagaccctttgggaccaatctataccaatggctcatgtggtgtcgtcgttgatagtcaccagaattgcattaccaatggccgtcctgactctggttttctctactggaaatggaagcctaacgactgctccctgccccgcttcgacgctcttaggtttctgcagcttatgaggaacaagtcttgggctttcattggtgactccatttcgcgtaaccatgtcgagtctttgctttgcatgctctccactgttgaaaaaccggttgaagtgtaccacgacgaggagtacagatcaaagcgttggctttttcctctacataatctgacaatctccaacatctggtcaccgtttcttgttaaagccgccatttttgaagactcaagtggtgtctcatctgctgcagtccagcttcaccttgatatactcgacaacacatggactgatctgtttcccagcattgactttgccatcatcttttccggggaatggttcttgaaaaccgcggtctaccacgagaatgctactcttgttggctgccatggctgcccgcaaagttccaacataacggacttaggattcgactatgcttacaacacgtccttgcgccatgtgatggacttcatcgcaagatccaacactaaaggcatgatctttttccgaacttcgatacctgatcactttgaaaacggtgaatggcataacggagggacctgtaagaaaacagaaccggtgaacgaggatgaggtcgagatgaaagtcttgaacaagatattgagagatgtagagattagtcagttcgagagggtggttacagagatgggtcaggaggctgggcattttaagcttctggactttgccggaatgttgctgacccgacccgatgggcacccgggtccgtatmgagagttcaggccgtttgataaggacaagaacgcaaaggtacagaacgattgtctgcattggtgcttgcctggtccgattgattacttgaacgatgttatattggagatcatagtgaatrgctgaatcaaaaacaccggtttggtctttcgtgtaaattgataaagttgaagaagttggatagagctcattgaagaattataaaacccagtttggttcatgatagctattattatggatcgatttttgtaaagtgatattttttcgtgggtttyctgttatatatgcaaaagtaagagatttcgagttacaaaaacaaataaataaagtatgtcttgt

SEQ ID NO: 168 - DNA, 135 bp, Arabidopsis thaliana
atgtggctatctcatgagctcttaccaagaggactgcgaagaatagaaatggtgccaacatcaattgtggaagagaccaaatgctttaaatgtatgtattgttgtgagttttatcgattaatgagtttggtctga

SEQ ID NO: 169 - DNA, 1302 bp, Arabidopsis thaliana
caaatctataactcatagattgcatctccttcttactttgtttgattagattgtattagcctctgtcttgtcttttggttagtataagtattgataaattcctttgaccagcaagatatcatcactaaaagattttacattaccaagccatctccaatatcatcaggtcaagtgatgttgtttctaaccgcggctgtctgtttaatatgcttttacgtctacaagtccgtgaaaccgccgccgccaattccattgccggagaatgtttctgagatatctccaagaatcaagctcaacgatggcagatatttagcttacaaagaattagggtttcctaaagacaaagccaaaaataagattatcattctccatggattcgggagttccaagttagtggatttaaaaatcacacaggaaatgatcgacgaattcgagatatacttcttgttgttcgatagagctggttatggagaaagcgatcctcatccatcacgaacactaaaaacggatacatatgacatcgaagaacttgctgacaaattgcaaatcggtccaaagttccatgtcctaggaatgtcactcggggcttatccagtttacggctgtctcaagtacattcctcatagactaagtggagcaacgttggtggttccgatactgaatttttggtggagttgtctgcctctaaacttgtcgatttcagcgttcaagaaattgccaattcaaaatcagtggacacttggagtcgcacactactttccatggttattatattggtggatgactcagaaatggttttccccatttagtcagaatcctagagaaactatgaccgagcgcgatatagagctcgcggataagcatacaaaacacgcatatattaaggaatccgcactacgacaaggtgaatatgtgagcatgcaacgagacatcattgcgggttacgagaattgggagtttgatccaaccgaactgagcaatccattttcagatgataacaaagggtcagttcacatttggtgtgcactcgaagacaaacaaatttcgcatgaggttttactctacttatgtgataagcttccatggataaagcttcatgaagtccctgatgctggacatcttattatccatgagaagcagcattttgaagacattattaaagccgcttgtagttgaaggttaaaaaaaaaaacttaattcaatagtttgtgtgtggactggatttgaaagttgatattatataaaatatatgttcaatgtcacatatatatattttgttacaattaaattcattttactact

SEQ ID NO: 170 - DNA, 1173 bp, Brassica napus
gaacattaactacatctcctaaatcatcaggccaaatgatgttgctgctacttgcgattgtggggttaacaagctactatgtctacaagttgataaaaccgccaccaccaattccactgccggaaaacgttaccaaaaaatctccaagaatcaagcttagtgatggcagacatatagcatacaaagaactagggtttcccaaggacgaagccaaaaacaaaataataatcatccatggatacgcaaattccaaagacgtcgatttatacaccactcaggaaatgattgatgaattcaagatatactttttattcttcgatagagctggctatggagaaagcgatcctaatccatcaagaacgctgaaaacagatacatacgatatcgaggaacttgctgacaaattgcaacttggtccaaggttccatgttttgggcatgtcacttggagcttacccagtttatggttgcctcaaatacattcctcatagattaagtggagcttcattggcggttccattaataaacttttggtggagacgcattcctcaaaacttgttaaatgcagcaatcaagaaattaccatttgagtttcaaatgacactacgagtcgcacactattgtccatggttgttatattggtggatgactcagaaatggtttccaagtaatcgagatcccaagaaaactctgactgaacgtgatatagaactttcggaaacatattcaaaaaaatcatacaaggacgctgttttacgacaaggtgaatatgtgagcagccaacgagacatcatcgcgggttacggtaactgggagtttgatccaaccgaactgagcaacccgttctcggatactaacaaaggatcagttcatatatggtgtgcactcgacgacaaacaaatmttgcgagatgttctggtctatatatgtgataagctgccatggataaagtttcatgaggttcctcatgctggacactggattatccatgagaagaagcatttcgaagccatcatcaaagccgcttgtactgaatgaaaattggagaatgaaaaaatgggaactctatcaaatttgcatatcgaataactaagtttaagaaaaccgtgtgtatattaagaaaaatattatatatgtcattgtcaatatatatatcttgtatgataaatattag

SEQ ID NO: 171 - DNA, 2134 bp, Raphanus sativus
gggtcacagaaacagagattcctcgctgtctgaactgaaaaataagatcgcattaactcaaagcgstcacaaagacaaagatcttcttcttctcttctcttttctcttttctctttcagataacgatggagaaccctccggatcaaacagagtcaaaggagatgatgcttcaacccataagaagaagacgaaagggtggtcttctcactatgcccttcatcattgcaaacgaggggtttgagaaagtggcgagctacggattactacagaacatgatactctacctgatgagtgactacggtttgggaattgtgaaaggacaaaccgtgttgttcatgtgggtcgctgctactaacttcatgcctctcgttggagcttttctatcagattcgtatttgggtcgctttctcaccatcgccattgcctctctctccagtttcctggggatggtgctactatggctaacggcgatgttaccgcaagtgaagccatcaccgtgtatagcatcagccggaaccaactgcagttccccggcagcgamatcttctcaactggctcttttgtattccgcatttgcacttatatcgatcggaycaggtggtatcaggccgtgttctctagccttcggtgctgatcaattggataacaaagagaatccgaagaacgaaagagttcttgagagtttcttcggttggtactacgcttcgtcatcggttgctgtcttgatcgctttcactgtcattgtctacattcaagatcatctaggatggagaattgggtttggtataccagcgattcttatgctactcgcgagtttagtgtttgtattggcgtctcctctgtatgttaaacgcaatgtgagcaagagcttgttcactggtttagctcaagcggctgttgcagcttacgtgaacaggaagttaatgttaccgggtcagagtgactcgtatggttgttatcaccacttgaaagattctgaactcaaagctccaagtgacaaattgaggtttctgaacaaagcttgtgtcataagaaaccgcgacgaagacatcggttctgatggtttggccttaaacccatggagactctacacaacagaccaagttgaggaactcaaggctttggtcaaggtgataccagtatggtccacggggataatgatgtctataaacgtgagccagaactcgtttcagctgcttcaagctaactcaatggacagacgtttgagcgacgattcaaccttcaaaatcccagctggatctttcggcatgttcactatcatagccctaatctcatgggtggttctctacgaccgagccatcctcccattagcttccaagatccgaggtagaccggttaggatcaacgtcaagatccgtatggggttaggactattcatatcattcctagcgatggcggtctccgcaactgttgagcattacagaaggagaaccgcgataagccaaggactcgcagacaacgccactgctacggtgaacatctcagcgatgtggctcgtaccgcagtacgtgctacacggtttagcagaggccttaaccggtataggacagacagagtttttctacaccgagtttcccaaaagcatgtcgagcatagctgccgcgctgtttggtctaggaatggctgtggctaatatattggctagtgtgatactcaatgtgatcaagaacagctcaaagaaaggtggagtgagctggattgaagataatatcaacaagggtcattatgattattactattgggttttggcgatcatgagcttcgttaatgttatctattacgtggtgtgtagctggtcgtatggtccgacggtggatcaggtgaggaatgataaggttaatggcgtgagagaggaggaacaagaagaagttgttaaaataaactaaagatttttatttagtttctttgttcatgattcatggtgtgtgttatataatcttttttatgtatgtaattagatttattatatattttattgattttggatttaggaagtagatgattattttagtaggtgtgcttattttattcttcttctttcaaaagccattgttggtgtgtgtattatattttgattaaagaatcaaaatttcaaaagggtagttttatgtta

SEQ ID NO: 172 - DNA, 1800 bp, Brassica napus
gaattctctcgaagttttgacagtcaactagggtttaccggaaacctcagactctctctcgctgcttactgtgatccgacgtgaaaatggcgctgcgacatctgagccggccgagagacatcgtaaagagatcgacgaagaagtacctcgacgaacccctttaccatcgtctcttcaaggacggcggatctgaggtcagtgtccgtcagcagctcaatcacttcctcaagggcaccaaacacgtcttcaaatgggaagtcggagacacgatcaagaagctccgtagccgcggcctctattacccagctctcaagctgtctgaagttatggaacatagagggatgaacaagacggtgagtgaccaagcaatccatctcgatctcgttgccaaagctcgtggaatcgctgctggggagtcttactttgtcggtcttccggaaacatctaagaccgagctcacctacgcgtctcttttgaactgctactgcaaggagttgatgactgagaaagccgaaggtctactcagcaagatgaaagagctcaacattaccgttagctccatgtcgtacaacagcctcatgactctctacacaaagacagggcaggccgagagggttccggggatgattcaggagatgaaggccgaggatgtcatgccggattcttacacttacaatgtctggatgagggctttggctgctaccgaggatgtttctggggttgagagagttattgaagagatgaatagagatggtagagttgctcctgattggactacgtatagcaacatggcgtctatatacgttgacgcgggactatctgagaaagctgagaaggctcttcaggagctggagatgaaaaacacggagagggattttaaggcgtatcagtttcttgttactttgtatggacgactggggaaactgaatgaggtttataggatttggcgttcgttgaggctggctatgccaaaaacctcgaatgtagcttatctgaacatgatacaagtgctggtgaacttgaaagatttgcctggtgcagagacactgttcaaggagtggcaagcgaactgctctacttatgacatccgggttgtaaatgtgatgattggagcttatgcaagagaaggtctcatcgaaaaagctaatgaactcaaggagaaatctccaagaagaggagggaagctcaatgckaaaacgtgggagctcttcatggattactatgtaaagaggggtgaaacggctcaagcactcgaatgtataactaaggcggtttctatcggcaaaggagatggtggcaagtggctaccgtcagaggatacagtcagagcgttgatgagccagttcgaggaaaagaaagatgttaacggagctgagagtttgttggagattttaaagaagggaacggatgatgtaggcgcagagacgtttgaatcattgataagaacatatgcagcagctggaaagagccatcctgctatgcgccagcgcctgaagatggagaaggtgaaggttgataaagcaacagagaagctgcttgatgaattatgtcaggacgagtgaggtctgttcaatctctcttctccttcattttttttatttccctttacaagcaagacattgttagtcgtgtaagagagagcatttgcattctctctgctatgtttcttattggtaataaaaaawawrkgytatwctgttcatgtttytgtgwrwtgswwkratcktakcwkksattcccagggaacaagacgaagccccgcggcaacgcaacgcccctcggagcggcatgtcgaagcgc

SEQ ID NO: 173 - DNA, 1673 bp, Brassica napus
gaaaatggcgttgcgacatttgagccgaccgagagacatcgtaaagagatcgacgaagaagtacctcgaggaacctctataccaccgtctcttcaagaacggtggatcagaggtgagtgtccgtcagcagctgaatcaattcctaaagggcactaatcacgtcttcaaatgggaagtcggagataccatcaagaagctccgaagccgcggcctctattacccagctctcaagctatctgaagttatggaacatagaggtttgaacaagacggtgagtgatcaagcaatccatctcgatctcgtcgccaaagctcgtggaatcgctgctggggagacttacttcgtcaatcttccggaaacatctaaaaccgagctcacctatgcgtctcttttgaactgctactgcaaggagttgatgactgagaaagcagaaggtcttctcaacaagatgaaagagctcaacattactgttagctccatgtcctataacagcctcatgactctttacacaaagacaggacaggccgagagggttccggggatggttcaagaaatgaaggctgagaatgtcatgcctgattcttacacgtacaatgtctggatgagggcactggckgctactgatgatgtttctggtgttgagagagttatcgaagagatgaacagagatggtagagttgctccagattggactacatacagcaatatggcgtctatatacgttgatgcgagactgtctgagaaggctgagaaggctcttcaagaacttgagatgaaaaacacggacagggattttaaggcgtatcagtttcttagtacattgtatggacggcttgggaaactgtctgaagtttataggatttggcgttcgttgaggctkgctataccgaaaacctccaatgtagcttatttgaacatgatacaagtgctggtgaacttgaaagatgtaactggtgcggagacactgttcaaggaatggcaagctaactgtactacttatgacatcagggttgtgaatgttatgattggagcttatgcaaaagaaggtctcatcgaaaaagcaaaagaactcaaggagaaagctccaagaagaggaggaaagcccaatgctaaaacgtgggagatcttcatggattactatgtcaagagttgtgagacggctcaagcacttgaatgtatatctaaggcagtttctatcggcaaaggagatggtggtaagtggttaccgtcgcaggaagcaatcagtactttaatgagccagttcgaggtaaagaaagatgttaatggagctgagaatttgttggagatttttaagaagggaactgatgatagtataggcgcagagatctttgaatcgttggtaagaacgtatgcagcagcagggaagagtcatcctgctatgcgccagcgtctgaagatggaaaaggttgaggttaatgaagcgacgcagaagcttcttgatgcattatgtcgccaagagtgagtaaggtctctgttcatctctcttctccttcatattttttcctttagggagggtacttgcattcttacatctctgtttcttatctatactattatttgcgaagtaaatttttagaatcgaactctcacgttaaaagttagagtggttaatatcgtgtatacccttaatgaataaaatctttaaattatct

SEQ ID NO: 174 - DNA, 1852 bp, Brassica rapa
ttttactagcttcacataggcaccattctttttgtttgtttgactttaaactccgacgatcgtttgagcctttccctctgcttcgattcccagtactatttcagagggaataaagaagtaaatatcagaagttatgaacccaaatcaagtccctaatgggtttgtgaaacctgttcctactgaagaagagaagggaaagattgaggaattgagaaagctgttagggccattgccggagaaactctcgggtttttgttcggatgatgcagttttgaggtatctaagagctcgcaattggcacgtcaagaaagctgccaagatgcttaaagaaaccttgaaatggagagttcaatacaaacctgaggaaatctgttgggaggagatagctgatgaagcagagacagggaagatatatagatctagttgtgtggacaaacacggacgacctgttcttatcatgagaccgagtgttgagaattcgaagtcggtgaaaggccagattagataccttgtgtactgtatggagaacgcaatccagaatttgccaccaggggaggaacaaatggtgtggatgatagatttcaacggctatagcttggtgaatgtatcgttaaaaactaccagagaaaccgctcatgtattacaagaacactacccggagagattatctttggccattctttataatcctcccmagttctttgaacccttctggaaggtggcaagacctttcttagagccgaagacacggaacaaagtcaagtttgtttactcggacgacccaaacaccaagcagatcatggaggagaacttcgaacatggacaaaatggagtcagcgtttggtggaaacgatgactcgggtttcgacatacacaagcattcagagaggatgaaagaagacgacaagaaaagattggctgcgctgaaggatactgcctccccttctctagactcactcagcttcttatcggtctctgatggtgccacctctgacagtgctcatctcgcctctgaagatgtgtccgaggacgagcatcagcctcatggtatgagtgagaagtagtatgcaataattgtaacgtcgcatgaatttatctaataaaactttcttctcagacattgtatgtttttttcatcttgttctcctccgcaatgagattcattatatatatttttaattttttcggaagtaataaaaccatacaatgcacgaaacacaagctgcaattataattttaatcccacatgtcgggggaacactgataaaaacatactgattgagcattttagtcttcagtttcttgatattgcttcatgatctctgcacagcctggtgatgctgcatcccttaggaaccccaagttgttagcgaaacgttcgtctgaagcaatgccgttgaaacgagtgagggtcacacgggcacggtcatgaccaggtgagacattggagcatcgtaactgagagctactaaccaacatggtatcacagaactgatcctcatggtcttcgctaaccaagatcctgtacgatcctgttgagtcggttctcgcctcgtgcctgtaggttaactccattgttctcctgtctttgcactccaatctaaccaccgcaccagggatgaaagtagatgccgaagtttcaaaaccagcgaggcaagtatcgcaatagacacggcctctgacgacgaaagggttcttgttcggacgagcagacatggctagagccggtaaaaagcagagagcaaccagaagaattgctttcgacatcgcagtgtctggaaaactttcacaaggatgagtttcttttcttacggaagatctgagatttgaaagcagagagtaatgagcgtct

SEQ ID NO: 175 - DNA, 1196 bp, Raphanus sativus
tttttgtttgtttgactttaaactccgatgatcttctgagcctttccctctgtttcgattcccttactgtytcagagacaaagatctctctgaccagacatttacgatcctggwagggaataaagaagtaaataacagaaattatgaaccctaatcaagtccctaatgggtttgtgaaacctgttcctactgaagaagagaagggaaagattgaggaactgagaaagctgttagggccattgccggagaaactctcgagtttttgttcggatgacgcagttttgaggtatttaagagctcgcaattggcatgtcaagaaagctgccaagatgcttaaagaaaccttgaaatggagagttcaatacaaacctgaagaaatctgttgggaggagatagctgatgaagcagagacagggaagatttatagatctagttgtgtggacaaacacggacgacctgttcttatcatgagacctagtgttgagaattcaaagtcgatgaaaggacagattagataccttgtgtactgtatggagaacgcaatccagaatttgccamcaggggaggaacaratggtgtggatgatagatttcaatggctatagcttggcgaatgtatcgttaagaactacwagagagacygctcatgtattacaagaacactaccctgagagattatctttggccattctttataatcctcccaagttctttgaacccttctggaaggtggcgagacctttcttagagccgaagacgcggaacaaagtcaactttgtttactcggatgacccaaacaccaagcagatcatggaggagaacttcgacatggrcaaaatggagtcagcgtttggtggaaacgatgactcgggtttcaacatagacaagcactcagagaggatgaaagaagacgacaagaaaaggttggctgccttgaaggacattgcttccccttccctagactcactcagcttcttatctgtctctgatggtgccacctctgacagtgctcatctcggctctgaagatgtgtctgaggacgagcaacagccccatggtatgaatgagaagaaggaatctatcccatgatgttagtatccaatgattgtaacgtcacatgaatttatctattgagactttcttttgagacattctatgttttctcatcatwtatatatttttaatatttcagaagca

SEQ ID NO: 176 - DNA, 1058 bp, Malus domestica
tcagaaactatctatgagcatatagttttgatcggaaataatgttggccatttttcacaaggcttttgctcatccgccggatgagctgaacagtccggcgtcttayaacggaagcaagaagcctaagcacccagaagagactctcagagacttcctctcccaccatcctcacaactccctctccatgggatttggcgatgctgctgtccttgcttacgtcaagccagatcaaggctcctactccaaacaccagaggttgttctgtgggtttgatgacatatactgcttgtttttggggagcttgaacaatctgtgtttactgaataagcagtatggtctaacaaaatgctccaatgaggccatgtttgtgattgaagcttatagaacccttcgagatcgtggtccgtacccagctgatcaggttgtgaaagatcttgaaggaagctttgcttttgttgtctatgacagcaagggtggcaatgtctttgctgcactgggttctgatggtggagaacaactgtattggggcattgcagccgatggatctgtggttatttctgatgaattggaggtcataaaagagggttgtgctaaatcatttgcccctttcccaaaaggatgcatgtttcatagtgagggaggattgatgagctttgagcatccaatgaacaagatgaaggcaatgccaagggtagatagtgagggggcaatgtgtggggccaacttcaaagtcgataaatacacaagggtcaacagcattccacgtgtcggaagtgaggctgattggactgagtgggcctcccattagtcattactgctttttgctttgtcactcgctcttactgtgcctcaaataataactttgatcttattttgtccatcgtctctttctaattttttaccatytcagcttcktctagtttttacctccgaacaaagatgtaaataactwgggtagttttcacttggcctatgtaagtattttttttcaggtgaagaagcacctaaaagtgcttttaataaaaaattcattgacggtcagtttgaaaatgcttttt

SEQ ID NO: 177 - DNA, 863 bp, Malus domestica
cacgaggcaaaaaccccacttataaaagtgacaaaacaaaaataaaatattaagatcataaactaggtattagcatttagttttgatcgggaaaaatgttggccattttccataaggcttttgctcatccaccggaggagctaaacagtcctgcctcttacaacggaagcaagaagcctaagcacccggaagagactctcacagacttcctctcccaccatcctcacaactccttctccatgggatttggccatgctgctgtccttgcttacgtcaagccagaccaaggctcttactcaaaacacccgaggttgttttgtgggtttgatgacatatactgcttgtttttggggagcttgaacaatctgtgttcactgaataagcagtatggtctaacaaaatgcacgaatgaggccatgtttgtgattgaagcttatagaacccttcgagatcgcggtccgtacccagctgatcaggttgtcaaagatcttgatggaagctttgcctttgttgtctatgacagcaaaggtggcaatgtctttgccgcactgggttctgatggtggagagcagctctattggggtattgcagcggatggatctgtggtaatttctgatgaattggaggtcataaaagagggttgtgctaaatcatttgctcccttcccaaaaggatgcatgtttcatagtgagggaggattgatgagctttgagcatccaatgaacaagatgaaggcaatgccaagggtagatagtgaaggggcaatgtgtggkgctaacttcaaagtggataaatacacaagggtcaacagcataccacgtgtcrgaagtgaggccaactggactgattgggcctcccattag

SEQ ID NO: 178 - DNA, 936 bp, Brassica oleracea
gtttctaattatagagaaacaaaactcctctcttagatttataaccttttttattgttgggttctctctcccctgtgaagaaacatgttggctatatttcatgaggcgtttgctcatccaccggaggaactccacagtccagcatctgagaaatgctctaaacagcccaaacttcctgaagaaaccttaaacagtttcttgtctcgttaccctctcaacactttctctatgtcttttggtaaagcagctgttctagcttacgttcgtccctctgcttccttttccatccaccaaagattgttctgtggatttgatgacatctactgtctcttctttgggagcttgaacaatctgtgtcagctaaacaagcaatacggtctcaccaagacaacgaacgaggccatgtttgtgattgaagcttataggactcttagagacagaggtccttatccagctgatcaagtcgtcaaggatttagatggtagctttgcctttgttgtttatgatagcaaagccggttctgtcttcacggctctgggatctgatggaggagtgaagctcttttggggaatagctgctgatggatctgttgtgatctcagatgatttagatgttattaaagagggctgtgctaaatcttttgctccatttcctacaggatgtatgttccacagtgaaggagggttaatgagctttgagcatccgatgaacaagatcaaggcgatgccgagagtggacagcgaaggagttctatgtggtgccaacttcaaggtggatgtgtactctcgtgttaacagtatccctcgtcgaggaagtgaagctaattggtctctctgaatacttgcactctctttctccgttcttgttcttgattacttttgttatggaccctctctaataataagacatgaataaaactgtatatagctttctact

SEQ ID NO: 179 - DNA, 782 bp, Brassica oleracea
gcttcttcattcttccttccaagattcttatctttattaaagagaaacaaaactcttcttttatatttgacttttcttttttcattgttgtgttctctctctccctctttctctcgctggagaaaaatgttggctatatttcacgaggcttttgctcacccgccggaggaactctacagtccggcgtctgagaaatgctctaaacagcccaaacttccagaagaaacattaaacgacttcttgtctcgtcactctgacaacactttctccatgtctttcggaaaagcagctgttcttgcttacgttcgtccctctgcttccttctcggtccaccagaggttgttctgtgggtttgatgacatctactgtctcttctttgggagcttgaacaatctgtgtcagctaaacaagcaatatggtctgaccaagacaacaaacgaggccatgtttgtgattgaggcttataggactcttagagacagaggtccttatccagctgatcaggttgtcaaggatttagatggtagctttgcctttgttgtttatgatagcaaagctggttctgtcttcacggctctgggatctgatggaggagtgaagctgttttggggaatagctgctgatggatctgtagtgatatcagatgatttggatgttatcaaagagggttgtgctaaatcttttgctccttttcctacaggatgtatgttccacagtgaaggagggctaatgagctttgagcatccgatgaacaagataaaggcgatgccgagagtggacag

SEQ ID NO: 180 - DNA, 1032 bp, Brassica rapa
gcttcttcattcttccttccaagattcttatctttattaaagagaaacaaaactcttcttttataattaacttttcttttttcattgttgtgttctctctctctttctctcgctggagaaaaatgttggctatatttcacgaggcctttgctcacccgccggaggaactctacagtccggcgtctgagaaatgctctaaacagcccaaacttccagaagaaaccttagacgacttcttgtctcgtcactctgacaacactttctccatgtctttcggaaaagcagctgttcttgcttacgttcgtccctctgcttccttctcagtccaccagaggttgttctgtgggtttgatgacatctactgtctcttctttgggagcttgaacaatctgtgtcagctaaacaagcaatatggtctgaccaagacaacaaacgaggccatgtttgtgattgaagcttataggactcttagagacagaggtccttatccagctgatcaggtygtcaaggatttagacggtagctttgcctttgttgtttatgatagcaaagcyggctctgtcttcacggcyctgggrtctgatggaggagtgaagctgttttggggaatagctgctgatggatctgttgtgatatcrgatgatttggatgttatcaaagagggttgtgctaaatcttttgctccatttcctactggatgtatgttccacagtgaaggagggttaatgagctttgagcatccgatgaacaagataaaggcgatgccgagagtggacagtgaaggagtcctatgtggtgctaacttcaaggtggatgtgtacacgcgtgttaacagtatccctcgtcgaggaagtgaagccaattggtctctctgaatgccttgcattctctcaacttcctaaatgatactttcctttccgcactttcatgctccgttcttgttcttctctacttctgttatggaataagccatgaataaaaactgtgaatagctttcgaggttctatataaaaataaatttctcagcgctca

SEQ ID NO: 181 - DNA, 985 bp, Brassica rapa
atttttccttcaaagtttcttattatagagaaacaatactcttctctttatttataacctttttttattttccctctccctgtggagaaacatgttggctatatttcatgaggcgtttgctcatccaccggaggaactccacagtccagcatctgagaaatgctctaaacagcccaaacttcctgaagaaaccttgaacagtttcttatctcgttaccctctcaacactttctctatgtcttttggtaaagcagctgttctagcttacgttcgtccctctgcttccttctcagtccaccaaagagtattctgtggatttgatgacatctactgtctcttctttgggagcttgaacaatctgtgtcagctaaacaagcaatacggtctcaccaagacaacgaacgaggccatgtttgtgattgaagcttataggactcttagagacagaggtccttatccagctgatcaagtcgtcaaggatttagatggtagctttgcctttgttgtttatgatagcaaagccggttctgtcttcacggctctgggatctgatggaggagtgaagctcttttggggaatagctgctgatggatctgttgtgatctcagatgatttagatgttattaaagacggttgtgctaaatcttttgctccatttcctacaggatgtatgttccacagtgaaggagggttaatgagctttgagcatccgatgaacaagatcaaggcgatgccgagagtggacagcgaaggagttctgtgtggtgccaacttcaaggtggatgtgtactctcgtgttaacagtatccctcgtcgaggaagtgaagctaattggtctctctgaatagttgcactctctttctccgttctggttctggactacttttgtgatggacaatctctaataagacatgactgtctattctactgtttgtttcttccttaagaaaataaaataaaattctcaactctctttaccaaaaaa

SEQ ID NO: 182 - DNA, 1167 bp, Phaseolus coccineus
gcccttaagcgaggggatcaacgcagagtaggccgggatcaaaatgttggccattttccacaaagcttttgctcatccacctgaagagctgaacagtcctgcttcttaccaaggctccaagaaacctaaggttcctcaggaaactctcaaagatttccttgctcaccatcctcacaacacttgctctatgagttttggtcatgctgctgtgctagcttatgttcgtcctgatcaacctttctctcttcatcaaaggctgttttgtgggattgatgacatatactgtatcttcttggggagcttgaacaatttgtccttactcatcaagcaatatggattgtcaaagaacactgatgaggccatgcttgtgattgaagcttataagaccctccgtgacaggggtccatacccggcagatcaagttgtgaaggaacttgatggcagctttgcctttgttgtgtatgacagcaaggttggcagtgtctttgcagcactgggttctgatgggggaatcaaattgtattggggtattgcagctgatggatctgtggtaatctcagatgatctacaagtcataaaggagggctgtgccaaatcctttgctcccttcccaacagggtgtatgtttcacagtgaaggagggttgatgagctttgagcatccaatgaacaagttgaaggcaatgccaagggtggacagtgaaggggccatgtgtggggcaaacttcaaagttgataagttttccagagtcaacagcattcctcgagtgggaagtcaatccaattggatggaatgggaccaacattagcataaaataaaaccttatggataataatgtcatctatgatccaatttacccttctgaatttgttttattttcttcttgcttcggttgttttcctgtttccttccggcatagtacatattgaagtgcttttcagacatgttaattgttgaccatggcgcttgtgttgtcactcacagagattaacatggttcatggcaggaacttgtgtgtcagtgttttattgcatgaagatgtgccaagtaggtcctaggaattgtatgtaatatgaatgacatggtgtacaaaatggatgaacaatgacaaactatagttactgcagtcaatttctgaatcaaaagtgcttcgcctagtttaatgcc

SEQ ID NO: 183 - DNA, 1254 bp, Theobroma cacao
aataatggttgaacccgacatggccatctctatttccatttcatctggcatattttttcataaaatctaatcactttctgtctggtttgaaagagtgaaaggaaaaaatgttggcaattttccacaaggcatgtgctaaccctcctgaggatctgaacagtccagcttctcacaaatcttctaagaagcctaaactgcctgaagaaaccctgaatgagttccattctcatcaccctcataacactttttccatgagctttggcaacgctgctgttctagcttacgttcgccctgaaagtccttatttagttcatcagaggttgttttgtgggtttgatgacatatactgcctcttcctagggagcttgaacaatctttgtacgctgaataggcaatatggtctgtcaaaggggagcaatgaggccatgtttgtgattgaagcatataggaccctgcgtgacaggggtccgtaccctgctgatcaggttgttaaggaccttgatggaagctttgcctttgttatctacgacagcaaggctggaactgtttttgctgcactgggttctgatggtggcgttaagctgtactgggggattgcagctgatggctctgtggttatatctgatgatttggaggtcatcaaagagggctgtgccaaatcctttgctcctttcccaacaggattcatgttccacagtgagggagggctgatgagcttcgagcatccaatgaacaaaatcagggcaatgccaaggacagacagtgaaggagtgatctgcggtgctaatttcaaggttgatgtttacgcaagggttaacagcattccacgtgtgggaagtgaaacaaattggactcactgggattcacattaagaacaaaagattgctatggttttcttctcccaagaccaagaggagtttgaggaccaaagctgaaacaaaatttctctaggatctcttctgtttctttcctcccctagttcttgacctttcttgtacttttcttgtttatgtttctgttgtttctttgggattgtaaataagataaaaccaaatgagtatcctacttttcttgtaaacttttccaattatctcacatttcgaagggtagttccccaaaaattcaagaatggaaaagagttcttgggcaaaacatatttcaatctgtaaatgactacccaaaatctacatcaatgtgtttataacttttaagccaatcgcaatcaagtgggcctaaatgcaagcccccattaca

SEQ ID NO: 184 - DNA, 1029 bp, Brassica napus
cttcttcattcttccttccaagattcttatctttattaaagagaaacaaaactcttcttttataattaacttttcttttttcattgttgtgttctctctctctttctctcgctggagaaaaatgttggctatatttcacgaggcctttgctcacccgccggaggaactctacagtccggcgtctgagaaatgctctaaacagcccaaacttccagaagaaaccttagacgacttcttgtctcgtcactctgacaacactttctccatgtctttcggaaaagcagctgttcttgcttacgttcgtccctctgcttccttctcagtccaccagaggttgttctgtgggtttgatgacatctactgtctcttctttgggagcttgaacaatctgtgtcagctaaacaagcaatatggtctgaccaagacaacaaacgaggccatgtttgtgattgaagcttataggactcttagagacagaggtccttatccagctgatcaggtcgtcaaggatttagacggtagctttgcctttgttgtttatgatagcaaagccggctctgtcttcacggctctgggatctgatggaggagtgaagctgttttggggaatagctgctgatggatctgttgtgatatcggatgatttggatgttatcaaagagggttgtgctaaatcttttgctccatttcctactggatgtatgttccacagtgaaggagggttaatgagctttgagcatccgatgaacaagataaaggcgatgccgagagtggacagtgaaggagtcctatgtggtgctaacttcaaggtggatgtgtacacgcgtgttaacagtatccctcgtcgaggaagtgaagccaattggtctctctgaatgccttgcattctctcaacttcctaaatgatactttcctttccgcactttcatgctccgttcttgttcttctctacttctgttatggaataagccatgaataaaaactgtgaatagctttcgaggttctatataaaaataaatttctcagcgct

SEQ ID NO: 185 - DNA, 1106 bp, Brassica napus
ggaaaaagaaagaaaaccagacaacggacttagattaaaacatacagccaccacttgacataatacatgtataaatactcaagaaacctaaccactttcttctctgcttctgcatttttcttcaaagtttctaattatagagaaacaaaactcttctcttagatttataaccttttttattgttgggttctctctcccctgtgaagaaacatgttggctatatttcatgaggcgtttgctcatccaccggaggaactccacagtccagcatctgagaaatgctctaaacagcccaaacttcctgaagaaaccttaaacagtttcttgtctcgttaccctctcaacactttctctatgtcttttggtaaagcagctgttctagcttacgttcgtccctctgcttccttttccatccaccaaagattgttctgtggatttgatgacatctactgtctcttctttgggagcttgaacaatctgtgtcagctaaacaagcaatacggtctcaccaagacaacgaacgaggccatgtttgtgattgaagcttataggactcttagagacagaggtccttatccagctgatcaagtcgtcaaggatttagatggtagctttgcctttgttgtttatgatagcaaagccggctctgtcttcacggctctgggatctgatggaggagtgaagctcttttggggaatagctgctgatggatctgttgtgatctcagatgatttagatgttattaaagagggctgtgctaaatcttttgctccatttcctacaggatgtatgttccacagtgaaggagggttaatgagctttgagcatccgatgaacaagatcaaggcgatgccgagagtggacagcgaaggagttctatgtggtgccaacttcaaggtggatgtgtactctcgtgttaacagtatccctcgtcgaggaagtgaagctaattggtctctctgaatacttgcactctctttctccgttcttgttcttgattacttttgttatggaccctctctaataataagacatgaataaaactgtatatagctttctactgttttgtttcttccttgagaaaaaaataaaattctcaactcttg

SEQ ID NO: 186 - DNA, 1454 bp, Brassica napus
cccasgcgtmcgaasccasagaaaaaaactaamaacagacrrcggaataaaaaaacaaataccaccgctttgagttatatataaactcaataaacctcaccactcttccttcttcattcttccttccaagattcttatctttattaaagagaaacaaaactcttcttttatatttgacttttcttttttcattgttgtgttctctctccctctttctctcgctggagaaaaatgttggctatatttcacgaggcttttgctcacccgccggaggaactctacagtccggcgtctgagaaatgctctaaacagcccaaacttccagaagaaacattaaacgacttcttgtctcgtcactctgacaacactttctccatgtctttcggaaaagcagctgttcttgcttacgttcgtccctctgcttccttctccgtccaccagaggttgttctgtgggtttgatgacatctactgtctcttctttgggagcttgaacaatctgtgtcagctaaacaagcaatatggtctgaccaagacaacaaacgaggccatgtttgtgattgaggcttataggactcttagagacagaggtccttatccagctgatcaggttgtcaaggatttagatggtagctttgcctttgttgtttatgatagcaaagctggttctgtcttcacggctctgggatctgatggaggagtgaagctgttttggggaatagctgctgatggatctgtggtgatatcagatgatttggaagttatcaaagagggctgtgctaaatcttttgctccttttcctacaggatgtatgttccacagtgaaggagggctaatgagctttgagcatccgatgaacaagataaaggcgatgccgagagtggacagtgaaggagtcctatgtggtgctaacttcaaggtggatgtgtatacgcgtgttaacagtatccctcgtcgaggaagtgaagccaattggtctctctgaatgcttgcattctctcaacttcctaaatgatactttcttttccgcactttcatgctccgttcttgttcttctctacttctgttatggaataagccatgaataaaaactgtgaatagctttcgaggttctatataaaaataaacttctcagcgctcattatctgctcttcaagcttctggaatacaacttgttctgtttctctgaatatgatttcagagaagtgtaaacaacatgctcgacgaccaggaactgcttgagagagaagatgacgtatcgatcatatttattccttactctcctttctgtaatgaaacgcgtgagagttgttcattttccttctacgtttcctcctcttgttcagtagtataatgcgttgagaatgtggtaatttttaccaactcttttaaggcgcttggcttcgccgtaaggaatgtacgagacttcttgttttggtgacctttcgttatgtc

SEQ ID NO: 187 - DNA, 1056 bp, Manihot esculenta
gctaataccgttcacattcgaatagcgaaaaagaaaagaaaaaatgttggccatattccacaaagcttttgctaatccaccagatgagctcaatagtcctgcatctcgaaatggtaataagaagcccaagcttccagaagagactctgagagagttcctctctcattatccagacaacactttctccatgagctttggtgaagctgccgtccttgcctatgttcgcccygacaactctttctcacagcatcaaaggttgttttgtgggtttgaggatatatactgcctgttcttggggagcttgaacaacttgtgtgtactgaataggcaatatggtttgacaaaggggactaacgaggccatgtttgttatcgaagcttatcggactcttcgtgatcggggtccataccctgctgatcaagttgtcaaggatcttgatggaagctttgcttttgttatctatgatagcaaagctggtaccgtctttgttgcgctgggctctgatggtggggtgaagatgtactggggtatcgcagctgatggttctgtagtaatatctgatgacatagaaatcataaaagcaggctgtgccaaatcatttgctcccttcccagcaggatttatgttccacagtgaaggaggattgatgagctttgagcatccaatgaacaaggtaagagcaatgccaagggttgatagcgaaggagcgctgtgcggtgcaaacttcaaggtagatgtatacacaaggatcaacagcataccacgcagaggaagtgaagctaattggacccaatgggactcccacaactgaaaatatttctatttgttcccttaatattaagctgccatgtaatgttttataattcccgtgtatttttcctcttttttctttcctatgttgtcgtctttcgattaatactaatattttagttgaaaggaaagaaaagctttccatgtgtacttgcttacggtctgcagccacatcatgaagaaaatatatctgcttattttagtactgttggattaatcttggaatgggactgagggagttatttc

SEQ ID NO: 188 - DNA, 1066 bp, Citrus sinensis
ttaatttctcaagaaaggaaattttgttataaagaatatgttggcgatatttcacaaggcgtttgccaatccgcctgaggagcttcatagccctgcgtctcaaaaatgttcgaagaggcctaaactccctgaggataccctcagtgacttcctctcccgtcactctgataacactttctccatgaactttggccatgctgctgttcttgcttacgtcccccctcactcccctttaaccaaggaccgaaggttgttttgcgggtttgaggacatatactgtctgttcatggggtccttgaacaacttgtgctcgctgatcaggcaatatgggttgtcaaagggaaccgatgaggccatgtttgtgatagaggcgtatcgtacgctcagagaccggggtccttacccagctgaccaggttgtcaaggatcttgatgggagctttgcttttgtggtctacgatagcaaggccggcacggtcttcactgctctgggttctgatgggggagtgaagctgtactggggaattgcagccgatggatctgtggtcatatctgatgacttggaggtcatcaaagagggatgtgccaagtcatttgctcccttcccacaggggtgcatgttccacagtgaaggaggattgatgagctttgagcatccaatgaacaagataagggcaatgccaagagtagatagtgaaggtgtcatgtgtggagccaatttcaaggttgataaatacactaggatcaacagcattccacgtgtgggaagtgaagcagactggactaatcaatgggactcacattaatttatcaattaaggatcaatttgattgatcttgctgtgaatttgcctacttccaactcaaaagctgaaactactacctttcatttttccttctattaagttaaaaataaagttgttactcactcttcgaggttcttttgacctttttctttgatagagtgtttttcttgttatgtgggcaatccgcaattgtgtatatattattaatcatgtttgggttctaattaatttgacttgtgtaatggaatgaagttgtcgtttg

SEQ ID NO: 189 - DNA, 1139 bp, Gossypium hirsutum
atccttatccatcaccagtttaacttctattacttccatttaatgattcacagtataaatggtgattcaacccttcaaactcccatctctacttccatttcatctgccatcaatttgctctgaagatcatgttggctatttttcacaaggcatttgctaatccaccagaggagctgaatagtccagcttctcataaatctactaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgcctcttcttagggagcttgaacaatctatttatgctgaatagacaatatggtctttccaaagggagcaatgaggcgatgtttgtgattgaagcatataggacgctgagggataggggtccataccctgctgatcaggttgttaaggatcttgaaggaagctttgcctttgtgatctatgacagcaagactggaaccgtgtttgctgcactggggtctgatggtggggtgaagctgtattggggaattgcagctgatggctctgtggtcatatctgatgatttagatgtcattaaagaagggtgtgccaaatcctttgctcctttcccaactggattcatgttccacagtgaaggggggctgatgagctttgagcatccaatgaacaaaatcagggcaatgccaagggtagacagtgaaggagtgatttgtggtgctaatttcaaggttgatgtttacactagagttaatagcattccacgagtgggcagtgcaaccaattggactgatcactgggattcccattaaagagagagagaagcaaaattaaacataagaaagatgccatgattatgttgttccaaagctctagacaaacactagggtttcttctgtttttcatcctagttgttggttttcctttgggtacttttctatgttatatgttggtsgtgttggtttaatttctttgggattgtaaataatgagcaaataacatacttaaacttattataatttcaatcttaattccaatttrymrmtgttgtaccc

SEQ ID NO: 190 - DNA, 1188 bp, Vigna unguiculata
ggctgcttttcctttatcaattttaatagttgtttgtagtgagggtagagattcctggtgctgaatcaaaatgttggccattttccacaaagcttttgctcatcctcctgaagagttgaacagtcctgcttcttacaaaggatccaagaagcctaaggttcctgaggagactctcaaagattttcttgctcaccatcctcagaacacttgttctatgagctttggtcatgctgctgtgctggcttatgttcgtcctgatcaacctttctctcgtaatcaaaggttgttttgtgggattgatgacatatactgtatcttcttggggagtttgaacaatttgtccttactcatcaagcaatatggcttgtcaaagaacactgatgaggccatgcttgtgattgaagcttataagaccctccgtgacaggggtccatacccggcagatcaagttgtgaaggaacttgatggcagctttgcctttgttgtgtatgacagcaaggttggaagtgtctttgcagcactgggttctgatgggggagtgaaattgtattggggtcttgcagctgatggatctgtggtgatctctgatgatctagaagtcataaaagagggttgtgccaaatcctttgctcccttcccaacagggtgtatgtttcacagtgaaggaggcttgatgagctttgagcatccaatgaacaagttgaaggcaatgccaagagtggatagtgaaggggccatgtgtggggccaatttcaaagttgataagttttccagagtcaacagcattcctcgagtgggaagtcaatccaattggatggaatgggaccaacattagcataaaataatccttatggataataatgtttaaataaaagtgtcatccatggtccaatttacccttctgaatctatttcctcttcgtcttggttgtgttgttttttcctgtttccttccggcatggtacatattgaagcgttttctcaaacatgttatgtgctgaccgtggtgcttgtgttgtcactcacatagattaacatggttcaagtcaggaacatctgtgtaagtgttttattgcattgagatgtgccaagtaggtcctaggaattgtaatgtaacatggatgacatggtgtacaaaatggatgaacaaggacaaactatagttactgcgctcaaaaaargaaaaaaa

SEQ ID NO: 191 - DNA, 1137 bp, Cynara scolymus
cggggtcccgccattacatcgatcacctttcctccctatttatagccaccctgcaactgccttcaattcctccattatcgttcatttttctgtttttcagctcgaaaaattctttggraaaaaaatgttggctatattccacaaggcgtttgcaaacccaccggamgaactgaaaagtccggcgagtaaccattccaataaaccaaaactcccagaagaaaccctcgaagagttcctatctgttcatcccacaaacaccttctctatgacctttggtgatgctgctgttcttgcttatgttaaacccgaccgcccttactccgttcatcaaaggatgttcactgcttttgatgatatatactgtgtrttcatggggagtttgaacaatttatgcgcccaaatcaaacaatacggactatcaaagaacaccgatgaagccatgttcgtgatcgaagcttatcggacgctccgagaccgtggtccgtacccggccgatcaggtgatcaaggatcttgaaggcagctttgcatttgttgtctacgatagcaaatccggcaccgttttcactgcgctgggctcagatggtggtgtgaagctttattggggcatagctgcagatgggtctgttgttatttctgatgatttagaggttatcaaagcaggttgtgcaaaatcttttgcaccatttcctaaaggttgtatgtttcatagtgaaggtggtttgatgagctttgagcatccaatgaacaagattagggcaatgccaagggtggatagtgaaggagttatgtgtggggctaatttcaaagtggatacctacactaggggtaattctattccacgtaggggtagtgaagccaattggaccaatgggataatcattattagcggatatcttatcccttaaatcccgtctctgaaagatatactggatttgtttgggaggaacagtcggtgtgtcttatctttcagatcctatcctcgagatatatgaagggtttgtttaatttggttccattagagagaatcctagtggatcttgattctacgctctacttctaatatatccttttgtttgtttcttgaatgtaaatattcgatttggggaataaagtcttattgttctatttgtgcacg

SEQ ID NO: 192 - DNA, 901 bp, Taraxacum officinale
taatacacaacytcctaaaaaacaagaaacatgttggccatcttccataaagcgttcgcacacccaccagaagagctaaacagcccagtagcacgccattgttccaagcaaccaaagctccccgaagaaaccctcgaagaattcctctccgttcaccccaaaaacaccttctccatgaccttcggcgacgctgctgttcttgcttatgttaagcccgatcgtacgaattactccgttcatcaaaggctgttcactgcgtttgacgacatatactgtttgttcatggggagtttgaacaatctctgtgctcaaatcaaacagtacggactttcaaagaacaccaacgaagccatgttcgtgatcgaagcttatcggacgttacgagaccgtgggccgtaccccgccgatcaggttattaaagatctcgaaggaagttttgcgtttgttgtttatgatagtaaaaccggatctgttttcactgcactgggttcagatggtggtgtgaagctatactggggaattgctgctgatggttcagtcgtaatttctgatgatttggaggtcataaaaacaggttgtgcaaagtcatttgcaccatttcctaaagggtgtatgtttcatagtgaagggggattgatgagctttgagcatccaatgaacaaaattagggcaatgccaagagtggatagtgaaggggtgatgtgtggggctaatttcaaagtggacaagtactcaagggtcaattctattcctcgtaggggtagtgaaaccaattggacccaatgggacgatcattattgatttttgatcaaagtggacaagtgctctcctaattacacctttttgtttgtttctgaatgtaaatatttgattttggggaataatttatgtatgagaatgc

SEQ ID NO: 193 - DNA, 1357 bp, Vitis vinifera
agatacatccaccgcatcatcatcttcatctaccccttataaatattgccccttctctcttgagttcatctccttattttcgctttacaaactaatacccacaattcatctaaagctttgagcgatgttggccatttttcacaaggcgtttgcacatccgccggaggagctcaacagtccggcgtctcgggatggttcaaggaagcccaagctgccggaggagaccctcagggaatttttatctgctcatcctgccaacactttctctatgagctttggcactgctgcagcgctagcttacgtttctccggacaggtcctacccaacccaccaaaggctgttcggtggatttgacgacatatactgtctattcatggggagtttgaacaacctgtgcatactgaataggcaatatgggctgtcgaaggggagcaatgaagccatgctcgtgattgaagcgtataggaccctgagggacaggggcccatacccagctgatcaggtggtgaaggatcttgaaggaagctttgcctttgtcgtctatgacagcaaagctgggactgtatttactgctctgggctctgatggaggagtgaagctgttctggggggttgcagctgacggatctgttgtgatctccgatgacttgggggtcataaaagcaggctgtgccaaatcttttgctcctttcccaacagggtgcatgttccacagcgatggagggttgatgagcttcgagcatccaatgaacaagatgaaggcaatgcccagaatagacagtgaaggggtgatgtgtggagccaacttcaaggttgatgtctactccaggatcaactccatgcctcgtgttggaagtgaagtcaattggtctaattgggaggactaccattagactcgcctgctctttcctgctcatcgtctgatcttcatcaacaacatccatcccaaccagcttcctagctttctttctttttatgatttgatatcctgaatgttcctcctttcctagttgggatttcatagaataaatgtcgcaagtgtaatgatatttcactactctttgaactaatgaatccaaagttgggggagagggaagagatatcattattatcccaaacacaaggaaaagggatcaggggtatgcacttgatacgattgagccttgaaaagacaaatcctgctctctctgaacaaaccaaacttggttgttttagctttgggacatgtcaatgtcatttgaatattcatcctaaacatattaggatgggcaatattttagtagttttcggaattcctctctcctcgtttcctccatctagttcaataaaatgaatgtgaatacgatttgaagagggga

SEQ ID NO: 194 - DNA, 894 bp, Lactuca sativa
ggggatccattctttcatccttttcccttgaatttacaacttcgaaaacaagaaaatgttggccatcttccataaggcgtttgcacacccaccggaagaactaaacagcccggcggcacaccattgcaccaagcaaccaaaactcccggaagaaacccttgaagaattcctttcagttcatcctacaaacaccttctccatgaccttcggcgacgctgctgctcttgcttatgtaaaacccgatcgtccttactccgttcatcaaaggttgttcactgccttcgatgacatatactgtttgttcatggggagtttgaacaatctctgctcccaaatcaaacaatacggactgtcaaagaacaccaacgaagccatgttcgtgatcgaagcttatcggacgctacgagaccgtggtccttaccccgccgatcaggtcatcaaagatcttgaaggaagtttcgcatttgtcgtctacgatagtaaatccggaactgttttcactgcactgggttcagatggaggagtaaagttgtactggggaatagctgcagatggatcagtcgtcatttccgatgatttagaggtcataaaagcaggttgtgccaagtcatttgcacctttcccgaaagggtgtatgttccatagtgagggtggtttgatgagttttgagcatccaatgaacaagattaaggcaatgccaagggttgatagtgaaggggtgatgtgtggggctaatttcaaagtggacacttactcaagggtcaattctatccctcgtaggggtagtgaaaccaattggacacaatgggatgatcattgttgatcgtgaatcataatcaatctacaaatttcccattttactttcactttttgtttgtctcccagatcccattt

SEQ ID NO: 195 - DNA, 972 bp, Lactuca sativa
ggggatccattctttcatcctttttacttgaatttacaacttcgaaaacaagctagaaaatgttggccatcttccataaggcgttcgctcacccaccggaagaacttaacagcccggcggcacaccattgcaccaagaaaccaaaactcccggaagaaacccttgaagaattcctttcagttcatcctacaaacaccttctccatgaccttcggcgacgctgctgttcttgcttatgttaaacccgatcgtcctaactccattcatcaaaggttgttcactgcctttgatgacatatactgtttgttcatggggagtttgaacaatctctgctcccaaattaaacaatacggactgtcgaagaacaccaacgaagccatgttcgtgatcgaagcttatcggacgctacgagaccgagggccttaccccgccgatcaggtcatcaaagatcttgaaggaagtttcgcatttgttgtctacgacagtaaagccggaactgttttcaccgcactgggttcagatggaggagtaaagctgtattggggcatagctgcagatggatcagtcgtcatttccgatgatttggaggtcataaaagcaggttgtgcgaattcatttgcacctttcccgaaagggtgtatgttccatagtgaagggggtttgatgagttttgagcatccaatgaacaagattaaggcaatgccaagggtggatagtgaaggggtgatgtgtggggctaatttcaaagtcgacacttacgcaagggtcaattctatccctcgtagaggaagtgaaaccaattggacacaatgggatgatcattgttgatcatgaatcatcatcaatctccaagatcccattttatttcaactttttgtttgtttcttgaatgtaaatatttaattttggaaaataatttgatgtatgccaatggtttagatatcacgtgggtgcaattcaaaatgtttttttt

SEQ ID NO: 196 - DNA, 1093 bp, Lactuca sativa
  misc_feature (1091)..(1091): n is a, c, g, or t
cgcgggggatcccattctttcatccttttcccttgaatttacaacttcgaaaacaagaaaatgttggccatcttccataaggcgtttgcacacccaccggaagaactaaacagcccggcggcacatcattgcaccaagcaaccaaaactcccggaagaaacccttgaagaattcctttcagttcatcctacaaacaccttctccatgaccttcggcgacgctgctgctcttgcttatgtaaaacccgatcgtccttactccgttcatcaaaggttgttcactgccttcgatgacatatactgtttgttcatggggagtttgaacaatctctgctcccaaatcaaacaatacggactgtcaaagaacaccaacgaagccatgttcgtgatcgaagcttatcggacgctacgagaccgtgggccttaccccgccgatcaggtcatcaaagatcttgaaggaagtttcgcatttgtcgtctacgatagtaaatccggaactgttttcactgcactgggttcagatggaggcgtaaagttgtattggggaatagctgcagatggatcagtcgtcatttccgatgatttagaggtcataaaagcaggttgtgccaagtcgtttgcacctttcccgaaagggtgtatgttccatagtgagggtggtttgatgagttttgagcatccaatgaacaagattaaggcaatgccaagggttgatagtgaaggggtgatgtgtggggctaattttaaagtggacacctactcaagggtcaattctatccctcgtaggggtagtgaaaccaattggacacaatgggatgatcattgttgatcatcaatcatcatcaatctccaagatcccattttactttaactttttgtttgtctccaagatcccattttacttcaactttttgtttgtttcttgaatgtaaatatttaattttgtagaataatttgatgtatgccaatggtttagatatcacgtgggtgcaattcaagaatgtttctttttggattcataaatattgctaacacgtagaaatcaattattgttcaatcccgaaacatcatatataaaggcacacaatttgntc

SEQ ID NO: 197 - DNA, 917 bp, Lactuca sativa
  misc_feature (811)..(811): n is a, c, g, or t
gcggggatcccattctttatcctttttccttgaatttacacacttcgaaaacaagaaaatgttggccatcttccataaggcgtttgcacacccaccggaagaactaaacagcccggcggcacatcattgctccaagcaaccaaaactcccggaagaaacccttgaagaattcctttcagttcatcctacaaacaccttctccatgaccttcggcgacgctgctgctcttgcttatgttaaacccgatcatccttactccattcatcaaaggttgttcactgcctttgatgacatatactgtttgttcatggggagtttgaacaatctctgctcccaaatcaaacaatacggactgtcaaagaacaccaacgaagccatgttcgtgatcgaagcttatcggacgctacgagaccgtgggccttaccccgccgatcaggtcatcaaagatcttgaaggaagtttcgcatttgttgtctacgatagtaaatccggaactgttttcactgcactgggttcagatggaggagtaaagttgtattggggaatagctgcagatggatcagtcgtcatttccgatgatttggaggtcataaaagcaggttgtgctaagtcatttgcacctttcccgaaagggtgtatgttccatagtgagggtggtttgatgagttttgagcatccaatgaacaagattaaggctatgccaagggtggatagtgaaggggtgatgtgtggggctaatttcaaagtggacacttacgcaagggtcaattctatccctcgtagaggtagtgaaaccaattggacacaatgngatgatcattgttgatcatcaatctccaagatcccattttactttaactttttgtttgtctccaagatcccattttacttcaactttttgtttgtttcttgaatgt

SEQ ID NO: 198 - DNA, 964 bp, Lotus japonicus
tttcattctttctattctcttattcaccattttgttctgagattcaaaatgttggccatttttcacaaggcttttgctcatccacctgatgagctaaacagtcctgcatcctacaagggtgccaagaagcctaaggttcctgaggaaactctaagagagtttctatcccatcatcctgataacactttttcaatgagttttggtgaggctgctgttcttgcttatgttcgccctgagcgacatttctccgttcgtccaaggctgttttgtgcaattgatgacatttattgtctctttctggggaccttgaacaacctgtgttcactcaataagcaatatggtttgacaaagggtactgatgaagccatgtttgtgattgaagcttataagacgcttcgcgaccgcggtccttaccctgcagatcaagttgtcaagggtcttgatggaagctttgcctttgttgtctatgacagcaaggttggcactgtctttgcagctctgggttctgatggtggagtgaagctatattggggtattgcagctgatggatctgtggtaatctctgatgatttagatgttataaaagagggttgtgccaaatcctttgctccctttccaacagggtgtatgtttcacagtgaaggaggtttgatgagctttgagcatcccatgaacaagttgaaggcaatgccaagggtagatagtgaaggggtcatgtgtggagctaacttcaaggttgataagtatacaagggtcaatagcatacctcgagtgggaagtcaagcccattggatggaatgggaacagcattagtttcaaaatgagacatgtataaacgtttaactgtttaagtgatgatgtatgtcagtatgtgtaataatgcaaataaatgccatgccacttatgttcctttcttaaatttgtcttaactctccttttccatacaactgatttacatttacat

SEQ ID NO: 199 - DNA, 934 bp, Cucumis melo
actctcttctcctatcgattttgatgaacccattaatttccatttctgaaaaatgttagccattttccaccaaacttttgcacacccacctgaggaacttaagagccctgcctctttcagtggctctaaggcccctaagcttcctcaagaaacactcratgacttcattwctcgtcatcctcwaaacactttctctgttaacttcggccaagccgctgttcttgcttatgtttctccccaatccttttcagtacaycaaaggctgttctgtgggtttgatgaaatatactgtctgttcttgggaagtttgaacaacctatgtgcactgaataaacaatatggtctatcgaaaggctcaaatgaggctatgtttttgatcgaggcgtataggacacttagagacagaggtccttacccagctgatcaggtcattaaggaccttgatggcagctttgcctttgttgtttacgatagcagggctggtgctgtttttgctgccttgggtgctgatgggggagtgaagctctattggggaattgcagcagatgggtcagtggtgatatcagatgatgtggatgtcatcaaagaaggctgtgctaaatcatatgccccattcccaactggatgcatgttccatagtgaaggagggttaatgagttttgagcatccaatgaacaaaatgaaagcaatgcctagaattgacagtgaaggagcaatgtgtggagctaacttcmaggttgatgtttacacaagagttaatagcattccaaggagaggcagtgaagctaattgggctgaatgggacacaaactagctacctacctgatacacatttacaatttctctcctctctgtgtggattttgctgctgttttcacatttwmctctcttctaagtctaacatctctttctcactccaatggcttgtatttat

SEQ ID NO: 200 - DNA, 1206 bp, Carica papaya
gtccgtgttcgtccccaccgaaattcctgtcacagaaaaccaggaaaaatcaaaaaccatcaacggtagcttctgtataaatactttcgagaatcctctggttccatctctctcgttgttcatcttcatcatcgagaaagatcaattaaagaaacatcagaagaaaaatgttggctatttttcacaaaacttttgctcatccgccggaggagcttaacagtcctgcttctcaaaaaaccagcaagaaacctaagctacctgatgaaaccctcaatgattttctctctcatcatcctcacaacgctttttccatgacctttggtcaagctgctgttcttgcttatgtcaaatctgacaaccccttttcccttcaccaaaggttgttctgtggtttcgacgatgtatactgtattttcctgggtgctttgaacaacctctgccatctgaacagacaatatggtttgacgaagaactctgacgaagccatgtttgtgattgaagcctatcggacactgcgtgaccggggtccctaccctgctgatcaggttgtcaaagacatggacggcagctttgcgtttgttgtctacgacagcaaagccggctgtgtctttgctgcactgggttctgatggtggagttaagctctactggggcatagcagctgatgggtctgtggtgatatctgatgatttggaggtcataaaagaaggctgtgccaaatcatttgctcctttcccaaccgggtttatgtttcatagtgaaggtgggttgatgagcttcgagcatccgacgaacaagataaaggcaatgccgagaattgacagtgaaggagtgctgtgcggagctaattttaaggtcgatatgtacaccagggtgaacagcattcctcgccggggaagcgaagctaattggactctcggcgattctcattagctgaatcattaaaattttcgaaaacctaatcaagttacaagctacccgtgctctacactgtttatgtttctccatcttctgttcttctcttctttctcctttcttgttctgttccatgttcatcttcctaaaaggaagagtacacgaatgtaaatactgggtttatgagcatttatatgtagaatccatgatttgtcgttcactttaatttttcatgttgttagtgaagaagctttattaaactcaattacttaaaagcttattctgttctaaa

SEQ ID NO: 201 - DNA, 1088 bp, Prunus persica
accttataaagagataaaaactccatttacaatctccttccttgccctaaaaaagcaacaaagaaaaaaagaaagtatattcaagcaaagaagttggctgattgatctgcatagttttttttcttttccaaaatgttggctattttccacaaggcttgtgctcacccaccagaggagctaaacagtcctgcttctcacaatggaagcaagaagcctaagctcccagaagagactctcacggagttcctcaaccaccatcctcacaactccttctccatgggctttggccgtgctgcagtgcttgcttatgtcaagccagaccaacccttttactcccaacaccagaggttgttctgtggttttgatgatatatactgcctgttcttggggagcttgaacaatctgtgtttgctaaacaagcagtatggtctaacaaaaaataccaatgaggccatgtttgtgattgaagcttataggacccttcgtgacaggggtccctacccagctgatcaggttgtgaaggatcttgatggaagctttgcttttgttgtctatgacagcaagggtggaaatgtctttgctgcactgggttctgatggtggagtgcagctttactggggaattgcagctgatggatctgttgtaatttctgatgaattagaggtcataaaagaggggtgtgctaaatcatttgctcccttcccaaaaggatgcttgtttcatagtgagggaggattgatgagctttgagcatccaatgaacaagatgaagccaatgccaaggatagacagtgaaggggccatgtgtggggccaccttcaatgtagataagtatacgagggtcaacagcattccgagggtcggaagtgaagcaaactggactgagtgggcctcccattaggaggacaagtatcattgtgctttgctttgtcaccgtcaccatggctgaraaaataacttgcttctaatctttttcgtttgtcctttgatctttttccttttttttctggttgtatttttgtttattttctatctacgaacaaggatataaatattggtatgatctttcagaagttgagtgtgttaaaa

SEQ ID NO: 202 - DNA, 1113 bp, Arachis hypogaea
ccctccttggaaatcggccattacggccggggctgcattatttcattccctttgatctacaaatagctaaatcattattatcattattattaagccaaaaccaataaagaaaaatgctggccatattccacaaggcttttgcaaatccaccagatgagttgaatagtccagcttcttacaaaggttccaagaagcctaagattcctgaagagactctcagagattttctttcccttcatccaaacaacacttgctctatcagctttggccatgctgctgttttagcttatgtccgccctgataatcctttctctcttaataaccaaaggttgttttgtgggtttgatgacatatattgtgtgttcttggggagcttgaagaatctatcatacatgaacaagcagtatggattgtcaaagggaagcaatgaagccatgcttgtgattgaagcttacaagaccctacgtgacagaggtccataccctgcagatcaagttgtcaaggaacttgatggtagctttgcctttgttgtctatgacagcaaggttggcagtgtctttgcagcactgggttctgatggaggggtgaagttgtattggggaattgcagctgatggatctgtggtgatctctgatgatctgcaagttatcaaagagggttgtgccaaatcatttgctccttttccaacagggtgtatgttccacagtgaagggggtttgatgagctttgagcacccaatgaacaagttgaaggcaatgccaagaatagacagtgaaggtgcaatgtgtggagccaattttaaggttgataaattctcaagagtcaacagcattccaagagttggaagtcaatctaactggatggaatgggatcaacattagccttattattattattactattttcacaataggaatgtaaaccaaaaatatgtcacatatcaatgtttctatgtttcctttaatttcctccctaaacccagatcgtcttggtttctgctgcctggaatggttttctgttctggtccttacctaggaatagtagacaacactcctcatacacataaaagaggataacctgttcggccggcctcggccatcatctttaatcagc

SEQ ID NO: 203 - DNA, 1257 bp, Populus trichocarpa
gtacgagaatccttatcaccaatcacactaagctccacgcccccaaagatggataatattacctatgtccaccttggaaaaacataaccttaatgtctgaaagtgatcctataaatactacttcagaccttggtggtcacctctccccgtctgtgatcgtatatcaattctttaaacaaaaaacaaaggcataaattttaggcaattttataggtttattttgtaagtgttagcttggaaagcagaggattagaaaatgttggcaatttttcacaaagcttttgctcacccacctgaggagcttaatagtccagcatctcaaaatggtactaagaagcctaagcttcctgaggaaacactcaatgatttcctttctcaccaccctcagaaaactttctccatgaactttggtcaagctgctgtgcttgcctatgctccccaagacaaccccttctctcctcaacaaaagctgttctgtggttttgatggtatatactgccttttctctggaagcttgaacaacttatgcacactcaataggcagtatggattgacaaaggggactaatgaggccatgtttgtgatagaagcttataagactcttcgtgatcgaggtccttatccagctgatcaagttgttaaggatcttgatgggagctttgctttcgttatctacgatagcacggctggaagtgtttttgctgcactgggttctgatggtggagttaagctgtactggggtattgcagcagatggctctgtggtgatatctgatgatttggaagtcataaaagaaagctgtgtcaaatcgtttgctcccttcccaacaggattcatgttccatagtgaaggaggcttgatgagctttgagcatccaatgaacaaagttagagcaatgccaaggaccgacagtgaaggatttctctgtggggcaaatttcaaggttgatgtctacacaaggatcaacagcttaccccgtagaggaagtgaagctaattggaccgagtggcaatcacacagctaagaatttgttgtgcttcaattcataaccggatcaaaaaatgttagcatcagctaccatcttccaaattgttatctattcttaacgttttctctgctttgttttgttttcgtttctatttttgtttattttactctgttttcttttcactcggtagtcggtacagctatcaataagagggcaacgtgttcaatcggtgcccagaaccttttatttatctattcacttttatgaat

SEQ ID NO: 204 - DNA, 1088 bp, Prunus persica; identical to SEQ ID NO: 201

SEQ ID NO: 205 - DNA, 856 bp, Raphanus sativus
ataaagctcaagaaacatcatcactctgkcttctgcattcttccttcccaagattcttatcttattatagagatacaaaactcttcttcattgttgtgttctcttctctctctctctcgctggagaaaaatgttggctatatttcacgaggcctttgctcacccgccggaggaacttaacagtccagcgtctgagaaatgctccaaacagcccaaacttccagaagaaaccttaaacgacttcttatctcgttaccctcaaaacactttctccatgtctttcggaaaagcagctgttcttgcttatgttcgtccttctacttccttctccgtccaccagaggttgttttgtgggtttgatgacatctactgtctcttctttgggagcttraacaatctgtgtcagctaaacaagcaatatggtctyacyaagacaacaaacgaggccatgtttgtgattgaagcttayaggactcttagagacagaggtccttatccagctgatcaggttgtcaaggatttagacggtagctttgccttcgttgtttatgatagcaaagctggttctgtcttcacggctctgggatctgatggaggagtgaagctgttttggggaatagctgctgatggatctgttgtgatctcagatgatttggatgttatcaaagagggttgcgctaaatcttttgctccgtttcctactggatgtatgttccacagtgaagagggctaatgagctttgagcatccgatgaacaagataaagcgatgccgagagtggacagtgaaggagtcctrtgtggtgctaacttcaagtggatgtgtatacgcgtgttaacagtatccctcgtcgtggaa

SEQ ID NO: 206 - DNA, 1065 bp, Raphanus sativus
gaccgctttgagttaataatataaagctcaaaacatcatcactcttgcttctgcattcttcctttccaagattcttatcttatatagagagagaaaactcttcttcattgttgtgttctcttctctctctctcgctggagaaaaatgttggctatatttcacgaggcctttgctcacccgccggaggaacttaacagtccagcgtctgagaaatgctccaaacagcctaaacttccagaagaaaccttaaacgacttcttatctcgttaccctcaaaacactttctccatgtctttcggaaaagcagctgttcttgcttatgttcgtccttctacttccttctccgtccaccagaggttgttttgtgggtttgatgacatctactgtctcttctttgggagcttgaacaatctgtgtcagctaaacaagcaatatggtctcaccaagacaacaaacgaggccatgtttgtgattgaagcttacaggactcttagagacagaggtccctatccggctgatcaggttgtaaaggatctagacggtagctttgcctttgttgtttatgatagcaaagctggttctgtcttcacggctctgggatctgatggaggagtgaagctgttttggggaatagctgctgacggatctgttgtgatctcagatgatttggatgtcatcaaagagggttgcgctaaatcttttgctccgtttcctactggatgtatgttccacagtgaaggagggctaatgagctttgagcatccgatgaacaagataaaggcgatgccgagagtggacagtgaaggagtcctgtgtggtgctaacttcaaggtggatgtgtatacgcgtgttaacagtatccctcgtcgtggaagtgaagccaactggtctctctgaatacttgcattgtcgcaacttcctaatgatgatactttctttcttcttttccgcactttcatgttccgttcttgttcttgtccacttttctttttatggaataagccatgaataaaactgtgaatagctgtggaggttctatataaaaataaacttttagcttctaga

SEQ ID NO: 207 - DNA, 814 bp, Raphanus sativus
gacttcttatctcgttaccctcaaaacactttctccatgtctttcggaaaagcagctgttcttgcttatgttcgtccttctacttccttctccgtccaccagaggttgttttgtgggtttgatgacatctactgtctcttctttgggagcttgaacaatctgtgtcagctaaacaagcaatatggtctcaccaagacaacaaacgaggccatgtttgtgattgaagcttacaggactcttagagacagaggtccttatccagctgatcaggttgtcaaggatttagacggtagctttgccttcgttgtttatgatagcaaagctggttctgtcttcacggctctgggatctgatggaggagtgaagctgttttggggaatagctgctgatggatctgttgtgatctcagatgatttggatgttatcaaagagggttgcgctaaatcttttgctccgtttcctactggatgtatgttccacagtgaaggagggctaatgagctttgagcatccgatgaacaagataaaggcgatgccgagagtggacagtgaaggagtcctatgtggtgctaacttcaaggtggatgtgtatacgcgtgttaacagtatccctcgtcgtggaagtgaagccaattggtctctctgaacaattgcattctcgcgacttcctaatgatgatactttctttcttttttccgcactttcatgttccgttcttgttcttgtccacttttctttttatggaagaagccctgaataaaactgtgaatagctttggaggttctatataaaaataaacttgttctgtttcttga

SEQ ID NO: 208 - DNA, 1000 bp, Carthamus tinctorius
gactccattcttatcactccaaaaccataaccctcttttctttttaacaaaaaaaacaaatatgttggccatattccacaaggcctttgcacacccaccagaagagctcaaaagtccttcttcatcccaccattcccataagccaaagctcccagaagaaaccctccatgaattcctctctcttcatcccaccaacaccttctccatgtccttcggtgacgccgccgttcttgcttatgttaaaccccatcatccccctcctgattactccctccatcatcaaaggttgtttactgcctttgatgatatatactgtgtgttcatggggagtttgaacaatctctgcgcccaaatcaaacagtacgggctgtccaagaacaccaacgaggccatgtttgtgatcgaagcttatcggacccttcgagaccgtggcccctatcccgccgatcaagttgtcaaagatcttgaaggcagtttcgcctttgttgtttacgatagcaaatccggcaccgttttcacggcactcggttcagatgggggtgtgaagctttattgggggatagctgcagatgggtctgttgtcatttctgatgatttggaggttatcaaagcaggatgtgctaaatcttttgcaccatttcctaaaggttgtatgtttcatagtgaaggtgggttgatgagctttgagcatccaatgaacaagattaaggctatgccaagggtagatagtgaaggtgttatgtgtggggctaacttcaaagtggatacctacaccagggttaattctattccacgtaggggtagtgaagccaattggacccaatgggatgatcactactagtcaagggatattcttggaaactgtgcccaacatcttatccttgaaatggaatcttatctttgaaatagatgttgggtcttttgttagctctttgtttgtttcttgaatgtaaatatttgattttggtaataaagatgtattggcaatgctttggttacc

SEQ ID NO: 209 - DNA, 1255 bp, Glycine max
atcacaatggcccttcctgagaatccctgctttccttttttttaatttgaatacttcttatgcaactatagtgaggctaagagattggtccataattaatcaaaatgttggctatattccacaaagcttttgctcatccacctgaagagctcaacagccctgcatcttacaaaggttccaagaagcctaaggttcccgaggaaactctcaaagatttcctttcccaccatcctcacaacacttgctctatgagctttggtgatgctgctgttctagcttatgtccgtcctgatcaatctttctctcgtcatcaaaggctgttttgtgggatcgatgacatatattgtctcttcttggggagcttgaacaacttgtccctactcaacaagcaatatggattgtcaaagagtactgatgaggccatgtttgttattgaagcttacaagacactccgtgaccggggtccataccctgcagatcaagttgtcaaggagcttgatggcagttttgcctttgttgtctatgacagcaaggttggcagtgtctttgcagcactgggttctgatggaggagtgaagctgtattggggtattgcagctgatggatctgtggtgatctctgatgatctagaagtcataaaagagggttgtgccaaatcctttgctccctttccaacagggtgtatgtttcacagtgaaggaggtctgatgagctttgagcatccaatgaacaagttgaaggcaatgccaagagtggacagtgaaggggccatgtgtggggccaacttcaaagttgataagttcgccagagtcaacagcattcctcgagtgggaagtcaatccaattggatggaatgggaccaacattagcttaaaaataaagccttaggataatgtaaaataaaaaaaaaaatgtcatctatgtatgctcctttcctaacttacccttctgaatttgttttgttttctgcttgcttgtgttgttttcctgtttccctttccggcatagtacattgaagtgctttttcagacatgttaatccgttgatcatggtgcttgtgagtgagagagattagcacggttcaagtcaagaactcgtgtgttgcagtgttttatacctgaagaaggggtcctacgttatacatgaattaagatgcactaagtaggtcatcggaattgtaatgtaaaatggatgacataatgtacaaaatggaaataaaagggatgaacaagaacaaattgcatgtttggattta

SEQ ID NO: 210 - DNA, 1246 bp, Glycine max
atactaggtagcacataagactatagataaataatgaagatgatcccttcttcagaatccctgctttccttttttgacttagatacttcttatgcaactatagtgaggctaagagttggtgcataattaatcaaaatgttggccatattccacaaagcttttgctcatccacctgaagagctgaacagtcctgcatcttacaaaggttccaagaagcctaaggttcctgaggaaactctcaaagatttcctttcccaccatcctcacaacacttgctccatgagctttggtgaagctgctgtgctagcttatgttcgtcctgatcaatccttctctcgtcatcaaaggttgttttgtgggattgataacatatactgtctcttcttggggagcttgaacaatttgtccctactcaacaagcaatatggattgtcaaagagtactgacgaggccatgtttgtgattgaagcttataagactctccgtgaccggggtccataccctgcagatcaagtggtcaaggaacttgatggcagttttgcttttgttgtctatgacagcaaggttggcagtgtctttgcagcactgggttctgatggaggagtgaagttgtattggggtattgcagctgatggatctgtggtgatctctgatgatctagaagtcataaaagagggttgtgccaaatcctttgctccctttccaacagggtgtatgtttcacagtgaaggaggtctgatgagttttgagcatccaatgaacaagttgaaggcaatgccaagggtggacagtgaaggggccatgtgtggggccaacttcaaagttgataagttcgccagagtcaacagcattcctcgagtgggaagtcaatccaattggatggaatgggaccaacattagcttagaaataaaaccttaggataatgtaaaataaaaaagtgccatctatgtatgttcctttcctaacttaccattctgaatttgttttgttttctgcttgcttgtgctgttttcccgtttccctttccggcattgtacatattgaattactttttcatacatgttaattgttcatcatggtacttgtgagtgagagagattaacacggttcaagtcaggaacttctgtatcacagtgttaagatcgatgcactgagtgggtcataggaattttaatgtaacatggatgacataatctacaaaaatggaaataaatggatgaacaagggcaaacttgagttactgca

SEQ ID NO: 211 - DNA, 937 bp, Glycine max
ataacaatccctattaaaatcttctaaaattaaattaccatatatagtcacattttctttacactttgtgaggtctaaaatgttgtccatttttcacaaggggtttgctcacccacctgaagagcttaaaagccctgcatctaacagtggctccaacaagcctaagattcctgaggaaactctaagagaatttctttctcatcatccccataacactttttctctgagttttggtcactctgctgttctagcttatactcgtcctgatccaccttcctttgttcatcaaaggttgttttgtgggattgatgacatatactgtatctttttggggagcttgaacaatttgtgctcactcaacaagcagtatggtttggcaaagggcaccaacgaagccatgtttgtgattgaagcttacaagacactccgtgaccgtggtccataccctgcagatcaagttgtgaaggatcttgatggcagctttggctttgttgtctatgacagcaaggttggcagtgtctttgcagcactgggttctgatggtggaattaagctgtattggggtattgcagctgatgaatctgtggtaatctcggatgatctagatgtcatgaaagaggggtgcgccaaatcctttgctccctttccaccagggtgtatgtttcacagtgaaggaggattgatgagctttgagcatccaatgaacaagttgaaagcaatgcctagaatagacagtgaaggggccatatgtggagccaacttcaaggttgacaagtacgcaagggtcaacagcatacctcgagtaggaagccaggctaattggatggaatggacccagcattagcccaaaaaataaaatagtttaaatgtggatttagtttttataaatataataaatttttgttttactttctaaagtgttttttagtctttataa

SEQ ID NO: 212 - DNA, 1032 bp, Fragaria vesca
cctgcactatttcttgcaaaacaaaaaaaggaaaagtagtaagcaaaagatcaaagaagaaaacagagcatatcttcaactgctagctattttgttcatcttcttctcaaaaaaaatgttggccattttccacaaggcttttgctcacccaccggaggagctcaacagccctgcttctcaccatggttccaagaagcctaagctgccagaagaaaccctcgaggagtttctctcccaccatcctcacaacaacttctcaatggggtttggagatgctgccgttcttgcttatgtcaaaccagaccaaccctattccctaaaacagaggctgttctgtggtttcgatgatatatactgtctgtttctggggagcttgaacaatctgtgtatgctgaataagcagtatggtctgacaaagaataccaatgaggccatgtttgtgattgaagcttatcggaccctccgagacaggggtccgtacccggctgaccaagttgttaaggatctcgatggaagctttgcctttgttgtctatgacagcaaggttggcagtgtcttcactgcactgggttctgatgggggagtacaattgtattggggtattgcagctgatggttctgtggtgatttctgatgaattacatgtcataaaagaaggatgtgctaaatcatatgctccgttcccaaaaggttgcttctttcatagtgagggaggattgatgagctttgagcatccgatgaataagatgaaggcaatgcccagaattgatagtgaaggtgccatgtgtggagctaacttcaacgtggacaaattcactaggatcaacagtattccacgagtcggcagcgaagcaaactggagtgctgagtgracatcacactaagacgammagtgacattgtgcytacgcgtgtcactgtgacrcsgcctgaactaatacttgcctgaacttttmycttaktcykwtctgcytaattttcartttgwaacwtttggacargkrwaaataatgaaakgatwtaagaaaaaaaaa

SEQ ID NO: 213 - DNA, 1022 bp, Helianthus annuus
  misc_feature (1010)..(1010): n is a, c, g, or t
ttccttccttccttycttctcacaataatataatattattatcattcaaaatcaaaatgttggcaatcttccacaaagcattcgcacacccaccagaagaactcaaaagcccagcaaaacacaaaacccagcccaaactccctgaagaaacactacaagaattcttgtccgtacaccccactaacaccttctccatgacgttcggtgatgccgccgtacttgcttacgttaaacccaacttgaattactcagtaaatcaaaggttgttcacttcttttgatgatatttactgtttgttcatggggagcttgaacaacctgtgttctcagattaagcagtacgggctgtccaagaacacmaacgaggccatgttcgtcattgaagcctaccgcaccttgcgcgaccgcgggccctaccccgcggatcaggttattaaggatcttgaagggagttttgcgtttgtcgtttatgatagcaagaccggcactgttttcaccgccctgggttcggatggtggagtgaagttgtattggggtatagcagctgatgggtctgtggtaatttctgatgatttagaggttataaaagcaggttgtgctaaatcatttgcaccgtttcctaaagggtgtatgtttcatagtgaaggtggtttaatgagttttgagcatccaatgaacaagcttaaggcaatgccaagggtggatagtgaaggggtgatgtgtgggtccaatttcaaagtggacacttactcaagggtcaactctatccctcgtaggggcagtgaagccaattggacccagtgggatgatcattatgcatcttaattcttcttgaatcttgatcagcttccaacatcccttttttttttttactttaaaagtttgttttacttgtttgcttttttattttcttttttttgatttcctgaatgtaaatatttgattatgtttgagaataattatgatggtttctagtgttgtttggttcaaaaattttgatatcttgaaacnaagaaaacacgc

SEQ ID NO: 214 - DNA, 960 bp, Helianthus annuus
ttccttccttccttccacaattatataataatattattatcattcaaatcaaaatgttggcaatcttccacaaagcattcgcacacccaccagaagaactcaaaagcccagcaaaacacaaaaccaagcccaaactccctgaagaaacactacaagaattcttgtccgtacaccccacaaacaccttctccatgacgttcggtgatgccgccgtacttgcttacgtcaaacccaacttgaattactcagtaaatcaaaggttgttcactgcttttgatgatatttactgtttgttcatggggagcttgaacaacctgtgttctcagattaagcagtacgggctgtctaagaacaccaacgaggccatgttcgtgattgaagcgtaccgcaccttgcgggaccgcgggccctaccccgcggatcaggttattaaagatcttgaagggagttttgcgtttgtcgtttatgacagcaagactggcacagttttcaccgccctgggttcggatggtggagtgaagttgtattggggtatagcagctgatgggtctgtggtaatttctgatgatttagaggttataaaagcaggttgtgccaaatcatttgcaccgtttcctaaagggtgtatgttccacagtgaaggtggtttaatgagttttgagcatccaatgaacaagcttaaggcaatgccaagggtggatagtgaaggggtgatgtgtggggccaatttcaaagtggacacttactcaagggtaaactctatccctcgtaggggcagtgaagccaattggacccagtgggatgatcattatgcatcttaattcttcttgaatcttgatcagctttcaacatcctttttttttactttaaaagtttgttttttgtttgtcttttttattttatttcttgaatgtaaatatttgaattttgtttgagaataataattatgatggtttctag

SEQ ID NO: 215 - DNA, 1019 bp, Juglans hindsii x Juglans regia
ggggataccgtcggccactagttattttgatgaaacttgggtttcaaagtctaaaaacatcaaagaaaagaagaaatgttggctatatttcacaaggcttttgctcacccacctgaggagctcaacagtcctgcatcatacaatggcactaagaagcctaagcttcccgaggaaactctcaatgatttcctctctcttcatcctcacaacacttcctccatgagctttgcagatgcagctgtgcttgcttatgttcgccctgaccctccttgccaacttcatcaaaggttgttctgtgggtttgaagatatctactgcctgttcttagggagcttgaataacctattctcactcattaagcagtacggtctatcaaagggcacgaacgaggccatgtttgtgatcgaagcgtaccggacccttcgagaccggggaccgtacccagcggaccaggttatcaaggatcttgatggcagctttgcctttgttgtctacgacagcaagactggaactgtctttgctgcactgggttctgatggtggagttaagctgtactggggtattgcagctgatggctctgtggtgatttctgatgatttggaggttatcaaagcgggctgtgccaaatcatttgctcccttcccaacagggtgtatgttccacagtgagggaggcttgatgagctttgagcatccaatgaacaaggtgaaagcaatgccaagggtagatagtgaaggggccatgtgtggggccaacttcaaggttgataagtacacaagggtcaatagcattccgcgtgtgggaagtgaatccaattggacccagtgggattcacgttagctaaaatgtgggtccttgtgtgcgatttcagagtctcacaaatccaattgttccctggatttgcccctctttcaaagtttttatttaataccttatgtttgtttttctccatgatggaatgagcacaaataatgggatgatcttctggatgatgttcgtctccttgtacaatgttttca

SEQ ID NO: 216 - DNA, 979 bp, Juglans hindsii x Juglans regia
  misc_feature (17)..(17): n is a, c, g, or t
tgtgttggtcccgggantcggccattacggccggggcccttcacatcgagagtgagagagagaggaagaaatgttggctatatttcacaaggcttttgctcacccgcccgaggagctcaacagtccttcatcttacaatgactctaagcagcctaagcttcctgaggacactctcaacgatttcctttctcatcatcctcgtaacacttccttcatgacctttggagatgcagccgtgcttgcttatgctgggcaagaccctccttgtccactccaccaaaggttgttctgtgggtttgaagatatatattgcctcttcttggggagcttgaacaacctattctcactgaataagcagtatggtctttcaaagggcagtaatgaggccatgtttgtgatcgaagcctaccgcacacttcgtgacaggggtccatacccagctgatcaggttattaaggatcttgatggcagctttgcctttgttgtctatgatagcaaggctggaactgtctttgctgcactgggttctgatggtggtgttaaactttactggggtgttgctgctgatggctctgtggtgatttctgatgatttggaagtcatcaaagctggctgtgccaaatcatttgcccccttcccaacagggtgtattttccacagcgaggaaggtttgatgagctttgagcatccgatgaacaagatgaaagccatgcccagggtagacagtgaaggggcaatgtgtggagccaacttcaaagttgacaagtacacaagggtcaacagcattccacgtgtcggaagtgaaaccaattggacccactgggattcacatcaaacttaaatgttgacactgtgctttcgtctttttatagtttgttcgtctttcttttctttgttcctttttttccatggatggttctcccaaataaaagatgaaaaggaaaacgtaccaaaaagttaatagacatgcgtcttttca

SEQ ID NO: 217 - DNA, 1466 bp, Brassica rapa
ctgaataattcatattcttgctccggttcgaaaacttgtatcttttgctttctgagttcttgattttcgctttatcggtgtaagaaaaggacatagcagttgaagtgttggttgggtgtttggttctcgatctcacgagataacttaggttttcttgttgctcccacaagaaagttttcttcttgtgacttcttcgcctaactttctccctcgatttaagaaagcataggggggaagaccaaaaaataaacaaaacatcaaagtctttctctcttttgttaaacaatggaagcatctactgatgacgagaagagacctatggttgacttggtcaaggataaaaatggaaccgatcaggttcttctccagaatcctaaaggcgcttctgtaaagattagtttacatggaggacaagttctttcttggaagactgagagaggtgatgaattgttattcaccagtgccaaggctaactctaagcctccccatccggtacgaggaggaatccctatatgctttcctcagtttggaactcgaggatcacttgagcaacacgggttcgcaagaaataagatgtggcttgtggaaaatgatccacctgctttaccgtccttcgactcaaccggcaaagcctatgtygayttggtacttaarycctctgatgaagacacaacaaggatctggcctcactgctttgagtttcacttgagagtttcactgggactagatgggaacctaactctgatatcacgagtcagaaacatcaactcaaagccttttagcttttccattgcttaccacacttacttctccatctccgatatcagtgaagtaagagttgaaggacttgaaactctagactatcttgataacatgcttgataaagaacggtttactgagcaaggcgatgcgttaacctttgagtccgagatcgatagagtgtacttgaactctaaagacgtggttgctgtgtttgaccatgagagaaaacgtactttccttatcgagaaagaaggtctacctgatgttgtggtgtggaatccatgggacaagaaagctaaagcattgccggatttgggagatgaagagtataaacatatgctttgtgttgatggtgcagcaattgagaaaccaatcaccttgaaaccgggtgaagaatggaccgggaaattaagtctctcacttgtcctttccacctgaaaaaaccggtaccggttatcttcaaaccgattgattcttcttctgtctctcttataattatatttttcggtatagtctatagaagaccatcacagtgtgcgtgtgattctttggtatcaaatcctgaatattaaaaggaaacctgagatttgaaaattgtcaccagtttttttggctgtgacaagatcttggttttgtgcgagatttaacttgtgttgtatgaagataatttgtattttgattatttaataaagctttttcgtttt

SEQ ID NO: 218 - DNA, 1573 bp, Brassica napus
cttttattcacattckraataattcatattcttgctccggttcraaaagttgtatcttttgatttctgagttcttgattttcgctttatcggtgkaagaaaaggacatagcagttgaagtgttggttgggtgtttggttctcgatctcacgagataacttaggttttcttgttgctccccacaagaaagttttcttcttgtgacttcttcgcctaactttctccctcgatttaagaaagcatasgggggggggggagaccaaaaaataaacaaaacatcaaagtctttctctcttttgttaaacaatggaagcatctagtgatgacgagaagagacctatggttgacttggtcaaggataaaaatggaaccgatcaggttcttctccagaatcctaaaggcgcttctgtaaagattagtttacatggaggacaagttctttcttggaagactgagagaggtgatgaattgttattcaccagtgccaaggctaactctaagcctccccatccggtacgaggaggaatccctatatgctttcctcagtttggaactcgaggatcacttgagcaacacgggtttgcaagaaacaagatgtggcttgtggaaaatgatccacctgctttaccgtccttcgactcaaccggcaaagcctatgttgatttggtacttaagtcctctgatgaagacacaacaaggatctggcctcactgctttgagtttgacctgagagtttcactgggactagatgggaacctaactctgatatcacgagtcagaaacatcaactcaaagccttttagcttttccattgcttaccacacttacttctccatctccgatatcagtgaagtaagagttgaaggacttgaaactctagactatcttgataacatgcttgataaagagcggtttactgagcaaggcgatgcgttaacctttgagtccgagatcgatagagtgtacttgaactctaaagacgtggttgctgtgtttgaccatgagagaaaacgtactttccttatcgagaaagaaggtctacctgatgttggtaagatcctaaaaccttaaccgtaatttgaaccggaatccggttatctaacagaattagattcttgtggttttgttgcagtggtgtggaatccatgggacaagaaagctaaagcattgccggatttgggagatgaagagtataaacatatgctttgtgttgatggtgcagcaattgagaaaccaatcmccttgaaaccgggtgaagaatggaccgggaaattaagtctctcacttgtcctttccacctgaaaaaaccggtaccggttaccttcaaaccgattgattcttcttctgtctctcttataattatatatttttcggtatagtctatagaagaacatcmcagtgtgtgtgtgattctttggtatcaaatcctgaatattaaaaggaaacctgagatttgaaaattgtcmccastttttttttggctgtgacaagatcctggttttgtgcgagattcaacttgtgttgtatgaagataatttgtatttttgattatttaataaascttctcgtctaag

SEQ ID NO: 219 - DNA, 1737 bp, Raphanus sativus
ggagaatacgtaacatgacattattaaaaatcgtcaattatacccagaaaatataattctagtgaagaattattcagtgattgatgaatgctcctttttaaaaataaaacatttttaaaatacaatttgcaggggcttttgattatgtgcaacttttcaacattgtattgcctaattattctgacttctctctctccctctcttttaaatatctccatcttcttttattctcatctgaataagagataattcagattcttgctccggttcgaaaagttgtaccttttgatttctgagttcttgatttcgctttatcggtgtaagaaaaggacatakcagttgaagtgttggttgggtgtttggttctcaatctcacgagataacttagggtttcttgttgttccccacaagaaagttttctttctttcttcttcttgtgacttcttcgcctaacctattttcctcgatttaagaaagcagaggtggggagaccaaaaaaataaataaataaaacatcaaagtctctctctcttttgtcaaacaatggaagcatctagtgatgatgagaagagacctatggttgacttgatcaaggacaaaaatggaaccgatcaggttcttcttcagaatcctaaaggagcttctgtaaagattagtttacatggaggacaagttctttcttggaagactgagagaggtgatgaattgttattcaccagtgccaaggctaactcaaagcctccccatccggtacgaggaggaatccctatatgctttcctcagtttggaactcgaggatcacttgagcarcacggttttgcgagaaacaagatgtggcttgtggaaaatgatcctcctgctttaccttcattcgactcaaccggcaaagcctatgtggatttggtacttaagtcctctgatgaagacacaacaaggatctggccttacagctttgagtttcacttgagagtttcattgggattagatgggaacctatcgctgatatcacgagtcagaaacatcaactcaaagccttttagcttctccattgcttaccacacttacttctccatctccgatatcagtgaagtaagacttgaaggacttgaaactcttgactatcttgataacttgcttgataaagagcggtttactgagcaaggcgatgcattaacctttgaatccgagatygatagagtgtacttaaactctaaagacgtggttgctgtttttgaccatgagagaaaacgtacattcctcatcgagaaagaaggtctrcctgatgttgtggtgtggaatccatgggacaagaaagctaaagcattgccagatttgggagatgaagagtacaaacagatgctttgtgttgatggagcagccattgagaaaccaatcaccttgaaaccgggtgaagaatggaccgggaaattaaatctctcccttgtcctttccacctgaaaaaaccggtaccggttatcttcaaacctattgattcttctttgtctctcttattattatatttttcggtatagtctayagaagatcatcacagtgtgtgtgtgtgtgattctttggcatcaaaatcctgaatattaaaaggaaacctgagatttgaaaaatgtcaccagttttttttggctgtgacaagatcctggttttgtgcgagattcatttaacttgtgttgtatgaagatagtttgtatttttggattattttaataaagctttttcgtttta

SEQ ID NO: 220 - DNA, 1604 bp, Brassica napus
gagagtttgcgaaatccggcggtcagtcgggtggatcttcggctccgccagcgaagagaggccgacccttcggtagtacgagtgcaaactctgcagctgcagcagctgcggcggcggcggcggaagcgatgtctccgtcagctctactcggcccttctcttctagttcacaattccttcgtcgtagagcagaacaacaagagaatagtgctggcgttacagagtggtctgaagagcgaggtgacatgggcgttgaacacacttacactgctctccttcaaggaaagagatgatattcgtagagatttcactcctcttgctaagatccctggcttgcttgacgcccttctcttaatcattgatgactggcgtgacatagctctccctaaggacttcacatgtggaactagggtcaggtctttaggtgtgaattcttctgtttcaggattcgggagcgagttcgatgctcttgcctctgttcaaccacctggatccggcgttggctcttcacctggtgagacgttagggaaaaagagccaacatcagtcatctcagtggtggaatgaagaggatggtttgttcaatctagacgatgaagggagagcagagaaacaactttgtgccattgctgcatctaacgtcatccgcaacttctccttcatgcctgataatgaaactataatggctcagcatcgccattgcttagaaactgtttaccaatgcataaacgatcatatggccgaggatgaagagctggtcacaaactcgcttgagaccattgtgaacctagcgcatttgatggatcttcgtattttcagctcgtctaaacagtcatacatcaagattaatgaaaagcaagcagttcaagctgtcttagggattctcaattcttctgtcaaagcttggaactgtgctgctgctgaactgctggggcgtttgataatcaatccagacaatgaacctttcattagtcccttgattccgcagatacacaagagactagtcgatctcttgagcataccagccgtcgatgcacaagctgcagctgttggggcactctacaatcttgtggaagtaaacatggattgtagattgaagcttgcaagtgagagatgggcgattgataggttgttgaaagtgataaagacgccacatccagttccagaagtctgcaggaaagctgcaatgattctagagaaccttgtctctgagccacagaacagagggttgctattggcgtatgagaatgcttttgctgagctgctttttcaagatggtaagtattctgattcgtttgcgaggattttgtatgaactaactgccagatcaaatagcagagtggcttcggctaggggaatctggggaatgtaatgtgtggggttggtcagtcagtgtccttctcagaagattagtggttttgattaactatgctgtaatgtattattattagtagtagacttcattatttgatatgtactgttaaagcaccgtattgtgaacaaaggagatgtgtttctcttctctgcactcacgaggcaaacgctctacttcggccgcgacggaggtgtgttggtgttgattttggtcctgtgtcccttctcttat

SEQ ID NO: 221 - DNA, 1227 bp, Brassica napus
cggcacgaggacagtgttattcggtctctccctctccctctccgccctccgcctctcgtacttcctccmcmscttgttcaccgtgaagatgtcgttgacggagctagacgacggactggtacgcagtatggccatcggagcagtcttctccgacttcggagggaagatacgttcggtggggttccataggactgatgatctattggtgacgtcgagcgaggacgattcgcttcgtctcttcgatatcgccaacgctaaacaggtgaaggttacatatcacaagaaacatgggactgatcgtgtatgctttacacatcatcccagctcttttatttgctcttctctttacaatcttgagtccactggagaatctctgagatatctctcaatgtatgataaccggatccttcgctactttaaaggccacaaagacagggttgtatcgctttgtatgtcgcctattaatgatagcttcatgtctggttctttagacagaagtgtcagactctgggatcttcgtgttaatgcctgccagggaattctacacctacgtgggagacctgctgtagcttatgaccaacaaggcctggtgtttgcaattgcaatggaaggaggtgctgttaagttatttgattccagatgctatgacaagggtccctttgacacatttctggtgggtggggatactgctgaggtcaatgatattaaattcagcaacgatggaaaatcaatgcttctcactaccacaaataacaatatctacgttcttgacgcatatcatggagagaagaaatgtggttttagtttggagccttcacagggtgcatccctagaagccaccttcacaccagatggcaagtatgttttgtcaggttcaggagatggaaccttacatgcgtggaacatcgagaacccatctgaggtggcgaggtgggagaacaacataggagtagtgtcgtgtctgaaatgggcaccgcgtagagcaatgttcgttgctgcctctacggttctcactttctggatccccaacgacggcgaggcaccagcccccgccgatcattctgccgaccaacaacctcctcagtgacgacttcattgtttgtttccatttgcattagtgtattgcggttttaatttttgacaataacatatcggaagtattagtatttttmatcacaaaatacactcttgaaattttgttaaccacaatataattttttttaaatt

SEQ ID NO: 222 - DNA, 1160 bp, Ricinus communis
atgtcgctaaatgcgctcgatgacgatacggtgcgtagcatgtccatcggagccgttttctctgattttggagggaaaataaattcagttgatttccatagaaaggatgacttattggtgactgctagtgaggatgattctgttcggctttatgatattgcaactgctaagttgctgaagacaacttatcacaagaaacatggtgctgacagaatatgctttacgcaccatcctagctctgttatttgttcctctaaatataatttggattctactggagaatccttacggtatttatcaatgtatgataataggtgtcttcgctacttcaaagggcacaaagacagagttgtttccctttgcatgtctccgattaatgacagtttcatgtctgcttctcttgaccacagtgtcagaatatgggatcttcgtgtaaatgcttgccagggaattttgcatctacgtggtagacctacagttgcatatgatcaacaaggtcttgtgtttgctgtggcaatggaagggggtgctattaaattatttgattcacgttcctatgacaagggtccctttgacacctttttagttggtggggacacggctgaggtttgtgatattaagttcagcaatgatggcaagtcaatgcttttgacgaccacaagtaacaacatatatgttctcgatgcatatggaggtgaaaagcgatgtgggttcagtttggaaccgtcaccaaatacaactatagaggcaacttttaccccagatgggcagtatgtggtatcaggctcaggagatggaaccttgcatgcctggaatatcaacatgcggaatgaggtggcgagctggaacagccatataggcgttgcatcgtgctttaaatgggctcctcgcagggccatgtttgttgctgcatcttctgttctgacgttttggatacctaatccctccaagtcaattggagagccgcgtgccatggagactgaaggtgtagctcaacctgagaatatttctcaatgatggaaaccaggtctttcactatctgcttcaatcatcttctatgctgtcaatccttatcaacattgcttgggccaaaatttttggtgtgcttgaatcggcctccgttttgtaaaattatagtttctgaaagtaaaatatctgat

SEQ ID NO: 223 - DNA, 1319 bp, Gossypium hirsutum
aaaaaatggcgacgaagatgtcacttactgagcttgacgacgaaatagtgcgcagcatgtcgattggcgcagttttctcagacttcggaggaaaaataaattcacttgactttcatcgaaaagatgatctattggtgactgccagtgaggacgattcggttcgcctttacgacattgccaatgctaagttgataaagacaacatatcataagaaacatggtgcggatcgaatatgtttcacacatcaccctagttctgttatatgctcttcgagacacaatttggaatcgaccggagaagccttgcgatatctttcaatgtatgataaccgatgccttcgctacttcaaaggacataaagagagagttgtttccctctgcatgtctccggtaaatgatagcttcatgtcaggttctcttgaccatagtgtgaggatttgggatctccgtgtaaatgcctgtcagggaattttacgcctacgtggtagaccaactgtagcatatgaccaacaaggccttgtctttgctgtggctatggaagggggtgccattaaattgtttgattcacgctcctatgacaaggggccgtttgatacatttttagttggtggagacacagctgaggtttgtgatatcaaattcagcaatgatggcaaatcaatgctattgacaaccacaaataacaacatatatgttcttgatgcatatggaggagagaagcgatgtgggttcagtttagaaccatctccaaatacaactatagaggcaaccattactcccgatggtcagtatgtgatctcagggtcaggggatggaaccttgcatgcctggaacatcaacatgcgaaatgaggtagccgcttggaacagccacataggtgttgcagcttgcttgaagtgggctcctcgtagggccatgttcgttgctgcatcaaccgttcttacattttggatacctaacaactgttcaaaaccagctgcagagaccggttccactgatgcacaagccgggctgcagtttgagcaagtcggccaataaacccagtgcctaatccccggtaaatcatcaatgaactcaatgcttttcttgttggaaataaactccaatgtgccattataaaaaaaaaaaaaaaaacaacttaatgtattcagattgggcatcagttggtaacatttagaaagtaaattaaatgttgagaatattttgtgttatggatttaaaccatttggttggttgttaagtaggttttgtaatataatcaaaactggtaatgatctaaattggtgtcatgaaattgaaaatgtccaaaaaaattttggg

SEQ ID NO: 224 - DNA, 1352 bp, Vitis vinifera
cttgcaaatcgcaatttcagaaacattgggatggcgccgttaaactaggtccctaataacgcgcagcgaatctcgacagtatccacgcaccttttctctccggcgattgaagactccagaatcttcccatcaatatatctccatatacttccgagtttgtcaacgacgatgatgtcgctcactgagcttgacgacgacactgttcgcagcatgtcaatcggagcccttttttctgatttcgtcggaaaaataaattctctcgattttcatcgcaccgacgatctcttggtcacagccagtgaggatgattcggtcagattgtatgatatcgcaaatgccaagttgctgaaaaccacctatcataagaaacacggtgctgatcgtatatgtttcacccaccacccaagctctgttatatgttcctcaagacacaatttagattctacaggagaatccctacgatatctatctatgtacgataatcggtgccttcgctacttcaaagggcataaagagagggttgtttccctctgcatgtctcctattaatgacagcttcatgtctggttctcttgatcacagtgtcaggatttgggatcttcgcgtaaattcttgccaggggattttacgtctacgtggtcgacctactgtcgcatatgaccaacagggccttgtctttgcggtggcaatggaagggggtgctattaaattgtttgattcacgttcttatgacaagggacccttcgataccttttttgtcggaggagatacagctgaggtctgtgatattaaattcagcaatgatggcaaatccatgcttttgacaaccacaaacaacaacatatatgttcttgatgcatatggaggagagaagcgctgtgggttcagtttggaaccatctccaagtacaaccatagaggcaacttttaccccagatggccaatatgtggtttcaggctcaggtgatggaaccttgcatgcctggagcatcagcatgcgacatgaggtggcatgctggaacagcaacataggagttacgtcttgcctgaagtgggctcctcgccgagccatgttcgtggctgcatccactgtactcaccttttggatacccaacgcctcaaaatcaactgcagaccccggtaacacagatcctgaagctggacctcaatccgaacatatttctcaatgaaaatccctcatatatttcatctcattagtttaaattaactgcagctgtcttgtgataacaaaatcttaacttaatgtgtaatttaattatcttaaatatttctaatcttgaggatttatgagccttaatattttcaatacgatatatacacaaaggttacctga

SEQ ID NO: 225 - DNA, 1284 bp, Populus trichocarpa
gtagaaaatatcaatcgttcttccttgtccaaactccatcgaaaccagatagacagactccatcaatatcagtggctatgatgtcgcttacagagctcgatgatgatacggtgcgcagtatgtctatcggagctgttttctccgactttggagggaagattaattcagttgattttcatcgaaaagacgatctgttagttacagctagcgaggatgattcggttcgtctttacgacattgcaagtgccaaattgctgaagactacatatcacaagaaacacggtacagatcgaatatgtttcacgcaccaccctagctccgttatttgttcctcagtataccatttagattctaccggagaatcattacgttatctatcattgtatgataatcgatgtcttcgctacttcaaaggccataaagacaaggttgtttctctctgcatgtctccaattaatgatagcttcatgtccagctctcttgaccacagcattagaatatgggatcttcgcgtaaatgcctgccagggaattttgcatttacgcggtagacccacagttgcatacgaccagcaaggtcttgtctttgccgtggcaatggaagggggtgctattaaactgtttgattcacgatcctatgacaagggtccctttgacacctttttagttggtggagatacagctgaggtttgtgatattaaattcagcaatgatggtaaatcaatgctattgactaccacaagtaacaacatctatgttcttgatgcatatggtggagataagcgatgtggcttcagtttggaaccatctcccagtacaactatagaggctacttttaccccagatggccaatatgtggtatcaggctcaggagatggaaccttgcatgcctggaacatcaacatgcaaaatgaggtgtcatgctggaacagtcacataggcattgcatcatgcttgaaatgggctcctcgtcgtgccatgttcgttgctgcctctactgttctaacgttttggatacctgacagctcaaaaccaactgtcgatcctcgtcccatggacactgaaggtgcagctccatctgaacatgtacctcaacaatgaatcctggtaacctcttttttgtttatgcttaaaaggaatcctaggcgcttagcttgttatgtgcaatggaaatcctggtaacctaatgtaccctttgttgggccaaaattttggtgtgtgcttgaatcggaccgagtttctgtatcataacacttttgtttaatgtttggatctcgtgatttca

SEQ ID NO: 226 - DNA, 1243 bp, Raphanus sativus
ggacccagtagactttccgaatcctaaactctcaccagagcgtattcgttctctctgtctccgcctctctctctcgggcttcacagtttgttcagtctcgaagatgtcgttgacggagctagacgacggaatggtacgcaggatggccatcggagcagtcttctctgatttcggagggaagatacgttcgktgggkttccataggactgatgatctactagtaacatctagcgaggacgattcactacgcctcttcgatatcgccaacgctaaacaggtgaagattacataccataagaaacatggtaccgatcgtgtatgctttactcatcatcccagctctcttatttgctcttctctttacaatcttgagtccactggagaatctttgagatatctctcaatgtacgataataggattcttcgctactttaaaggccacaaagacagggttgtatccctttgtatgtctcctattaatgatagcttcatgtctggttctctcgaccgaagtgtccgactctgggatcttcgtgttaatgcctgccagggaattctacacctacgtgggagacctgcagtagcttatgaccaacaaggcctggtctttgcaattgcaatggaaggaggtgctgttaaattgtttgattccagatgttatgacaagggtccctttgatacgtttctggtgggtggtgatactgctgaggtcaatgatataaaattcagcaacgatggaaaatctatgcttcttactaccacaaataacaatatctatgttcttgatgcttatcatggagagaagaaatgcggttttagtttggaggcttcacagggtacatccatagaagccaccttcacaccagatggcaagtatgttctgtcaggttcaggagatggaaccttacatgcgtggaacatcgagaacccatctgaggtggcgaggtgggagaacaacataggagtagtgtcgtgtctgaaatgggcaccgcgtagagcaatgttcgttgctgcctcctcggttctcactttttggatccccaacgacggtgaggcaccagcccccgctgatcttcctgccgaccaacaacctcctcagtgacgacttcattgtttgtttccgttatgcaatatacacttgataacattatcggaagtattagtacwtttaatcacaatatacactattgaaattttgttaaccacaaaatacaaartttthgaaaaattactaatttttgca

SEQ ID NO: 227 - DNA, 1388 bp, Glycine max
ttagtaaaagtaaaacaacagtgaaaaagcgacgacggattcttctgctttgtttccactctcttgctactttgctccgccaacatgacggcgtcgctcacggagcttgacgacgatttggttcgaagcatggccataggagccgttttctccgacttcggtgggatgatacattcgattgatttccatcgaaaggatgatttacttgtcacagctagtgaggatgattcggtgcgactttatgacattgctaatgctaagttattgaagagcacttatcataagaaacatggtactgatcgtatatgttttactcatcatccaagctctgttatatgctcttcaaagtacactttggagtctactggagaatcattgcggtatttatcaatgtatgataatcgctgcttacgatacttcaaagggcataaacagagagttgtttctctctgcatgtctccaatcaatgatagcttcatgtctggttctctagaccacagtgttaggatatgggatcttcgggtaaatgcttgccagggcatcttacatctacgtggtagacccgctgttgcgtatgaccaacaaggcctggtctttgctgtagcaatggaagggggagctattaaattatttgattctcgttcttatgacaagggtccctttgacacctttctagttggtggtgacacagccgaagtttgtgatatcaaattcagtaatgacggcaaatcaatgcttctgactactactaataacaatatttatgttcttgatgcatatggaggagagaagcgttgtggatttagtttggaaccatctcctggtaccccaatagaggctacatttaccccagatgggaagtacatggtggcaggatctggaagcggaaccatgcaagtttggagtattgagaccaaaaatgaggtggcatgttggaccagccatattggtgtgccttcgtgcttgaagtgggcccctcgcagggccatgttcgctgctgcttcaagtgttctcacattttggatacccaataatgattcaaagctggaaacccagtatggtggcacagatgctgaagctggaccttaaccctaaccacttctccattataactgaatatgctgttcctctcccagcccatctacaattttgttttgttgttgtatcaagaaactaactaacgcgttgtgaatttggtaagctatacatagttttgatacatttcatgaaaattttgatgatgctccaaggatgttgtcaattgtaaatcccatcaccaaatgcaatttattttaaagttttagctacattgagaatgttctttattggttagacaatatttttccccgctagtaatactagggtcttacacatgttaaagacgtttt

SEQ ID NO: 228 - DNA, 1270 bp, Thellungiella halophila
gagagtattcgttctctcttgctctctcgcctctctccttctcggaaaattctcggtgctacactgtttgttcatctggacgatgtcgttgacggagctagacgacggactagttcgcaggatggccatcggagcagtcttctctgatttcggagggaagatacgttcgatgggtttccataggactgatgatctactggtaacatccagcgaggatgattcacttcgcctcttcgatatcgccaacgctaaacagctcaagattacataccataagaagcatggtaccgatcgtgtgtgctttacccatcatcccagctctcttatttgctcttctctatacaatttsgagtcactggagaatccttgagatatctctcaatgtatgataatcggatccttcgctactttaaagggcacaaagacagggttgtatcgctttgtatgtcgcctataaatgatagcttcatgtctggttctctcgacaaaagtgtcagactctgggatcttcgtgtaaatgcctgccagggaattctacatctacgtggtagacctgcagtagcgtatgaccaacaaggattggtgtttgcaattgcaatggaaggaggtgctgttaaattatttgattcccggtgttatgacaagggtccctttgatacatttctggtgggtggggatactgctgaggttaacgatataaagttcagcagtgatggaaaatccatgctcctaacaaccacaaataacaatatttacgttctcgatgcatatcatggagagaagaratgtggatwtagtctggagccgccttcacagggtacatccatagaagccaccttcacaccagatggcaagtacgttctttcaggttcaggagatggaaccttgcatgcgtggaacgttgagaacccatmtgaggtggcgaggtgggagaacaacataggagtagtgtcgtgtctgaaatgggcacctcgtagggcaatgttcgttgctgcctcgacggttctcactttytggatccccaacgacggtgagacacctgcccccgccgatcctcctgccgactaacaagtaacaacgcaaacaaacaaccatgatttgaatcaaacggactttagacaacattattagatgcggacgcattccaacctcctccttagtgacgaccgcattgtttccatttcgcattgtttccattttatgcacttgtgtattatggttttgattttgacaattaaaattatattgaagcaggagtaatttatttcag

SEQ ID NO: 229 - DNA, 1350 bp, Brassica juncea
cttagcctctccgtcgctgtttcagtagccgtcgccatcgacaaggctcctctggtagaagatggtttggtgataaacggcgacttcgaaacgtcaccgtcgagtggcttccctgacgacggaatagttgatggacctagcgagatcccaagctggaaatccaacggcacggtggagctaatcaactccggtcagaaacaaggcgggatgatcctcatcgtcccacaaggtcgccacgccgtacgattaggcaacgacgcagagatcagccaagaactgacggtagagaaaggttttgtctactcagtcacgttcagtgccgctcgcacgtgcgcccagctcgagtcgataaacgtgtcggtggcgtctgtgaacgcagacgagggtgacacgttggcgtcacgggacgtggatttgcagacgctgtacaacgttcagggatgggacccatacgcgtgggcgtttgaagcagaagaggatcatgttcggctggttttcaagaaccctggcatggaggatgaccccacctgtgggcccattatcgatgacattgctatcaagaagctcttcactcctgataagcccaaagataacgcggttataaatggagattttgaagaaggtccatggatgttcaggaacacgtcacttggtgtcttacttccgacgaatctcgacgaagaaacttcgtctcttccaggttggactgttgaatcgaaccgggcggtccggttcgtggactcggaccacttctcggttccagggggcaaacgagccgtggagcttctctcagggaaagaagggattatttcgcaaatggtcgagaccaaagcagataagccttacttgttgtccttctccctcggccacgcaggtgataaatgcaaggaaccattggctataatggcattcgcaggagatcaggcgcagaactttcattacatggcgcaagcaaactccactttcgaaaaggtcggtttgaatttcacggccaaggctgatcgaaccagagttgcgttctacagcgtttattacaacacgaggactgatgatatgagctctttatgcggacctgtgatcgatgacgtcagagtttggttctccgggtcgaagaaaatgggaggtcgttttgggttcgcagtttctgtttttgttcttctggttatcggtttggtgtagtaactcaggttttggatttcccggtttttcacctatgttattgcaaaaccaagaattcttctgggattttgtatgtttatcgaaccggttaagcatactagaaattcgaaagtattcagcctttatgcaaaatcaatgttctaatgtaaaataagaaaacttctcatgtca

SEQ ID NO: 230 - DNA, 1444 bp, Brassica rapa
gggctgcccgaaaagaacatacagaaacactttctcgtttcacactaatagaaagagaaagaagtgggagataaaagagagaacactagagggtgagaaagaagagataatggctccgaacaacaatagatgcaaatggagttccattttcatgcttcttcttagtctctccctcgccgtctcagtcgccgtcgccaccgacaaggctcctctggtagaagatggtttggtgataaacggcgacttcgaaacgtcaccgtcaagtggcttccctgacgacggagtagttgatggtcccggcgagattccaagctggaaatccaacggcacggtggagctaatcaactccggtcagaaacaaggagggatgatcctcatcgtcccacaaggccgtcacgccgtacgattaggcaacgacgcagagatcagccaagaactgacggtggagaaaggttctgtctactcagtcacgttcagcgccgctcgcacgtgcgctcagctcgagtccataaacgtgtcggtggcgtccgtgaacgcaaacgagggtgacacgttggcgtcacgggatgtggatttgcagaccctgtacaacgttcaggggtgggacccatacgcgtgggcgtttgaagccgaagaggatcatgttcggttggttttcaagaaccctggcatggaggatgaccccacttgtgggcccattatcgatgatattgctatcaagaagctattcactcctgataaactcaaagataacgcggttataaatggagattttgaagaaggtccatggatgttcaggaacacgtcacttggtgtcttacttccgacgaatctcgacgaagaaacgtcgtcccttccgggttggaatgttgaatcgaaccgggcggtccggttcgtggactcagatcacttctcggttccagggggcaaacgagccgtggagcttctctcagggaaagaagggattatttcgcaaatggtcgagaccaaagcagataagccttacttattgtccttctccctcggccacgcaggtgataaatgcaaggaaccattggctataatggcattcgcaggcgatcaggcgcagaactttcattacatggcgcaagcaaactccactttcgagaaagtcggtttgaatttcacggcaaaggctgaccgaaccagagtcgcgttctacagcgtttattacaacacgaggactgatgatatgagctctttatgtggacctgtgatcgatgacgtcagagtttggttcgcagggtcgaagaaaaccggagctggttttgggtttggagtttcggtttttgttcttctggttatcggtttagtttagtaagtcgggatttaaatttcccggttttcgctcatgttattgcagaacaaagaattcttccaagattttgtatgtttatctatccggttaagcattctagaaatt

SEQ ID NO: 231 - DNA, 1453 bp, Raphanus sativus
gggskgcccgaaaagaacatacagakacacactttcccgtttcacacttatagaaagagaagaagtgggagataaaaaagagaacattggtgagaaagaagaagaggtagaaacggagagacaatggctccgaacaacaatagatgcaaatggagttccattttcatgctcctgcttagtctctccctcgccgtcgccaccgacaaggctcctctggtagaggatggtttggtgataaacggcgacttcgaaacgtcaccgtcaagtggcttcactgacgacggagtagttgacggacccagcgagatcccaagctggaaatccaacggcactgtggagctagtcaacccggtcagaaacaaggsgggatgatcctsatcgtcccacaaggccgtcacgccgtacgattaggcaacgacgcagagatcagccaagaactgacggtkgagaaaggttctgtctactccgtcacsttcagcgccgctcgcacgtgcgcccagctcgagtccataaacgtgtcggtggcatcagtgaacgcaaacgagggtgayactttggcgtcacgggacgtggatctgcagacgctgtacaacgtccaggggtgggacccatacgcgtgggcgtttgaagcagwagaggatcatgttcggttggttttcaagaaccctggcatggaggatgaccccacttgtgggcccattatagatgacattgctatcaagaagctcttcactctgatmaacccaaagataaygckgttrtaaatggagattttgaagaaggtccatggatgttcaggaacacgtcacttggtgtcttacttccracraatctcgacgaagaaatttcctctcttccgggttggaatgttgaatcaaaccgggcggtccggttcgtggactcggatcacttctcggttccagggggcaaacgagccgtggagcttctctcagggaaagaagggattatttctcaaatggttgagaccaaagcggataagccttacttattgtccttctccctcggccacgcaggtgataaatgcaaggaaccattggctataatggcattcgcaggagatcaggcgcagaacttccattacatggcgcaagcgaactcaactttcgaaaaggtcggtttgaatttcacggccaaggctgatcgaaccagagttgcgttctacagcgtttattacaacacgaggactgatgatatgagctctctatgcggacctgtgatcgatgacgtcagagtttggttctccgggtcgaagaaaatcggagccggttttgggttcgcagtttcggtttttgttcttctggttatcggtttggtttagtaactcagggtttagatttcccggtttttcacctatgttattgcaaaaccaagaattcttctgggattttgtatgttttatctaagcgattaagcatactagaattcaaaagca

SEQ ID NO: 232 - DNA, 1235 bp, Raphanus sativus
taagattgaggaaataatataataaataaatatctctctagtctttcataattataattttcccacataaagagagtgagttagctccatgcccaaatcggatgaccacacaaaatcagcaaacaagaacataaagaaaatagaaaagaaacagaaagaagaacatgcaaacaacatggcatctccatgtcgtaagcttcataggttttctctctctccttagactactctatcctctcttgaaatggttcatcacgagattcctcctcactgaccccgggcgggtcaagcgttatggctcgtgggctttggtcactggagccacagatgggatcggacgagcctttgctcacgagctggcaaaacacggccttaacctcatcctagtcagcagaaacccttcgaagctcgcttctgtttccgatgatttccgacaagagtttccacaaatcaagatcaagatcattccctttgacttctcctctgaaagaggatatgaagctatcgaggaggggatcaaagaccttgaagttggaattctgataaacaacgttgggataacttacccacgagccatgttcttccacgaggttgaccaactcacatggaccaaaatcattagggtcaatcttgaagccaccacttgggtcacaagatctctcatcggaccaatgcttcaccgccgtcgaggagctatcataaatattagctccggtgccgccgttgttgtcccttctcatcctctctatgccatctacgccgccaccaaagcctatgttgataaactatcaaggtctttgcatgtggaatataagcattttggtatccacgtccagtgccaggttccgttatacgtggcaacgaggatggtatcagaagtagcagatatagataaaccaagcttctttgtaccatcgccggaagtatatgcaaaagcggcggtggagcagatcggaattggatcacgatgctcgccattttgggctcattcccttcagtggtttctcgctggtcttttgccgaagaaccttcttgatacttggcgtctctctatcggtcttcgtagaagaagtttgtcttagtttagtccctcgctttttatgtttgaagttattaagtttatatattttccggttacttcctttaacatataaaattactccaaaataaattttacaaaaatatgttatgaacgtatgaaataagrccttttaagttctaccacaagaacttga

SEQ ID NO: 233 - DNA, 1067 bp, Brassica rapa
ggtgcaaggggcgggttattacctagtttacagtaaaaccctaatcgtctcgatcgcaacctgagagtgagagttctctctactcgcttctctcgcaatggcggattctcccaacgaagaaagggactcacgatctcctcctccaccccgaaaagaacaaccaagatctaggtctaggtccaggtccaggtccaggtccatgccgagagataggtctaggtcaagatctttaccaaggcatgtatctccatcaagaacccgtggaaggtcgaggtcaagaagccgtggaaggtctgaaattgaaaaccctggtaccactctctatgtgaccggcttatccacaagagtcacagaaaaggatcttgaagcttatttctccaaggaaggaaaggttgcgtcctgcgttctagtgctggagccgcgcacccgcgagtctcgtggttttgcctttgtcacgatggatagtgttaaagacgctgagcggtgcattaagtatctcaaccattctgtactagaaggccgatacataactgtcgaaaggtcccgaagaaagcgcccgagaactcccaccccaggccactatcttggcttaaaaagctccagagacaatgaccgagatagccgtagcagtcgagggaggcactacgatcgtgatgattctggacaccgtaggtcaccaccaagacgcgacttatcacctcgtgatcatggaaggaggtcacctcgtgatcatggaagaarctctagaagagatcggtcttactctcctcgtggaagaagcccagagagaaggtccgagagaaggtatcaacctcgtggctcgagatgacctgtttaagtctcttgacgaaggcatttaagaacttctgtgttgatttagattgtatgattgatcattattatatttaaatagtacagagattctgtttggggacagtaatggctttgtgtcttttttctcttatgtatgctgcagaacacagtgaatgtgaaacttacaatgtaatagcttctctatgctactttgtttttttatgagtgaattataatttctatttgattaaaaa

SEQ ID NO: 234 - DNA, 1302 bp, Brassica napus
ccacgcgtccgaaagaagcatcttagagaaagagaatagagcgagagagattgaaagctttagggtttcaaaaaaactgagccctctagaaagtctctgtacaggaaaagcttcttctcgatatcttcagaaaatgggcgtcatgatcaaccaccatttgctcgctatcgtctttggcatcttaggaaacgcaatatccttcctcgtattcctcgctccagtgccaactttttatagaatttacaagaaaaaatcgacggaaagtttccagtctctaccgtaccaagtgtcgctatttagctgcatgctatggctctgttacgcattgattaagcaagacgcttttctcttaattaccatcaactcttttggctgcgttgtggagactatctacatcgccatgttcttcacttacgctaccaaggacaaaaggatcgcggccatgaagttgttcttaacgataaacgttgctttcttctcgttgattctaatggttacacatttcgcggttaaaagacctagcctccaagtctctgtcctcggctggatttgcgttgctatttctgtttctgttttcgcggcccctctaatgatcgtggcgcgtgtgataaagacaaagagtgttgaattcatgcccttcacgctttctttcttcctcaccataagcgccgttatgtggtttgcttatggcttattccttcatgacatatgcatagctattccaaacgtggtgggattcatactagggatggtacaaatgcttttgtacggaatttacagaaatccgggggagaaattagatactgagaaaaagatgaatccatcagaccagcaacttaagagtgttgtcgtgatgagtccgttaggtgtgtcagaagtacacccaattgacgtcaatgtgactgaaccagtggacccattctctgacgcggttcaacataaagatccatccaaagttactaaagagaaggagccggcaactgatgacggaaagtgccacgtggaaactgcccgtcatgaatctgtctgatgtgtcaaatgtatttcaacaagaagcaaaatatttctctctcaccctttctctttctcgtgggccttggctctcggccggccgaaggaagaaactgtatcgatcggtggtttggttccatttttgtttcctaccttatttagtattatcaatgtacttgcattaagttctatgttataaagttttatcttttaaagtgaatatattatctttgtaatttataactattctgctcttatgtttccagaacaaagaaatgtggctcagttgcg

SEQ ID NO: 235 - DNA, 1007 bp, Brassica oleracea
aaacaaatcctctgctgctgatatcttattacctccttctcaatggctcataataaccgttttgccatcttcctcactttcctctatgccatcgctggcctttccgccgccgcgttggtcgaggagcagccgcttgttctaaaataccacaacggtgttctcttgaaaggaaacgtaaccgtcaatctcatttggtacggaaagttcacacccatccaacggtccgtgatcgtcgacttcatccgctcgctcaactccaaagacgccgcatcctccgcctctccttccgtcgcttcctggtggaagacgactgagaaatacaaaggcggatcctcgacactcgtcgtcgggaaacagcttctcctcgagaactatccactcggaaaatccctcaagaacccttacctccgttctttgtccaccaaacttaacggcggactccgttctatcaccgttatcttaacagcgaaagacgtaaccgtcgagggtttctgtatgaaccgatgcgggtcacacggaacctctgtttccaagccccgtcgcgccgctaacggcgccgcttacgtctgggttgggaactccgagacgatgtgtcctggttactgcgcgtggccgtttcaccaacccatttacggaccgcaaacaccgccgttagttgcgcctaacggtgacgttggggttgacggaatgatcataaacctcgctacacttctagctaacaccgtcacgaatccgtttaataacggttattaccaaggcccgccaactgcaccgctcgaggctgtctctgcttgtactggcatattcgggtcgggttcttacccaggttacccgggtcaggtcctcgtcgacaaaacaaccgggtctagttacaatgctcgtggactcgccggaaggaaatatctcttgccggcgatgtgggatccacagactttaacgtgtaaaactcttgtctgaaccaagtgatgttaatgtggcacgtcgcatagtaccgagagcaattatga

SEQ ID NO: 236 - DNA, 1195 bp, Brassica rapa
aaacctcaaataaaacctctgttctatctcttacaataaccaacttctcaaatggcttataattaccgttttgcctttttcctcaccgtcctcaccgccctcgccgggatctcctccgccgcgttggtcaaggagcagccgcttgttctgaaataccacaacggcgctctcttgaaaggaaacatcaacgtcaatctcgtttggtacgggaagttcactcccacccaacggtccgtgatcgtcgacttcatccgctcgctcaactccaaagaagccacaacctccgccgctccctccgtcgcctcgtggtggaagacgacggagaaatacaaaggcggagcttcgactctcgtcgtcgggaaacagctcctcctcgagaactaccccctcggaaaatctctcaagaatcctaacctccgtgctctatccaccaaacttaacggcggtctccgttcgataaccgtcgtcttaacggcgaaagacgtttccgtcgaggggttctgtatgaaccggtgcgggtcccacggatcgtccgtctcgacttcgcgccgcgcggctaacggcgaggcttacgtctgggtcggaaacgccgagacgatgtgcccagggtactgcgcgtggccgtttcaccagcccatttacggcccacaagggccgccgttagttgcgcctaacggtgacgttggagtcgacgggatgattataaacctggctacgcttctagctaacaccgtcacgaatccgtttaagaacgggtattaccagggcccaccaactgctccacttgaagctgtctccgcttgtaccggcatgttcgggtcgggttcttacccgggttacgcgggtctagtgctggttgacaaaactaccgggtctagttacaacgctcgtggactcgccgggaggaaatatctattgccggcgatgtgggatccacagacgtcgacttgcaagactctggtttgatccaagggatgtgagtatgacacgtgtcatgttctggaaggaatgaggagatctagatgacatctatagtcaaaacaagttgtaactcgcgcttgtataatatatgctttcgggtttggactgtggataagagtctttgcttttgtcgttttgttgtgacgtgtaaattatgtttcttgaatgtgaagatatatgaatagtataaaataaaatgattttgtttctgttg

SEQ ID NO: 237 - DNA, 1191 bp, Brassica napus
gaaacctcaaacaaaacctctgttctctctcttacaatatccaacttctcaatggcttataattaccgttttgcctttttcctcaccgtcctcaccgccctcgccggtatctcctccgccgcgttggtcaaggagcagccgcttgttctgaaataccacaacggcgctctcttgaaaggcaacatcaacgtcaatctcgtttggtacgggaagttcactcccacccaacggtccgtcatcgtcgacttcatccgctcgctcaactccaaagaagccgcaacctccgccgctccctccgtcgcgtcgtggtggaagacgacggagaaatacaaaggcggagcttcgactctcgtcgtcgggaaacagctcctcctcgagaactaccccctcggaaaatctctcaagaatcctaacctccgtgctctatccaccaaacttaacggcggtctccgttcgataaccgtcgttttaacggcgaaagacgtttccgtcgaggggttctgtatgaaccggtgcgggtcccacggatcgtccgtctcgacttcgcgccgcgcggctaacggcgcggcttacgtctgggtcggaaacgccgagacgatgtgtccaggatactgcgcgtggccgtttcaccagcccatttacggcccacaagggccgccgttagtttcccctaacggtgacgtcggagttgacgggatgattataaaccttgctacgcttctagctaacaccgtcacgaatccgtttaagaacgggtattaccagggcccaccaactgctccacttgaagctgtctccgcttgtaccggcatgttcgggtcgggttcttacccgggttacgctggtctagtgctggttgacaaaactaccgggtctagttacaacgctcgtggactcgccgggaggaaatatctcttgccggcgatgtgggatccacagacctcgacttgcaagactctggtttgatccaagggatgtgagtatgacacgtgtcatgttctggaaggaatgaggagatctagatgacatctaagtcaaaacaagttgtaactcgcgcttgtataatactatatgctttcgggtttggactgtggataagagtctttccttttgtcgttttgttatgacgtgtaaattatgtttcttgaatgtgaagatatatgaatagtataaaataaaatgcttttgttt

SEQ ID NO: 238 - DNA, 1198 bp, Brassica napus
aaataaaacctctgttctatctcttacaataaccaacttctcaaatggcttataattaccgttttgcctttttcctcaccgtcctcaccgccctcgccgggatctcctccgccgcgttggtcaaggagcagccgcttgttctgaaataccacaacggcgctctcttgaaaggaaacatcaacgtcaatctcgtttggtacgggaagttcactcccacccaacggtccgtgatcgtcgacttcatccgctcgctcaactccaaagaagccacaacctccgccgctccctccgtcgcctcgtggtggaagacgacggagaaatacaaaggcggagcttcgactctcgtcgtcgggaaacagctcctcctcgagaactaccccctcggaaaatctctcaagaatcctaacctccgtgctctatccaccaaacttaacggcggtctccgttcgataaccgtcgtcttaacggcgaaagacgtttccgtcgaggggttctgtatgaaccggtgcgggtcccacggatcgtccgtctcgacttcgcgccgcgcggctaacggcgaggcttacgtctgggtcggaaacgccgagacgatgtgcccagggtactgcgcgtggccgtttcaccagcccatttacggcccacaagggccgccgttagttgcgcctaacggtgacgtcggagtcgacgggatgattataaacctcgctacgcttctagctaacaccgtcacgaatccgtttaagaacgggtattaccagggcccaccaactgctccacttgaagctgtctccgcttgtaccggcatgttcgggtcgggttcttacccgggttacgcgggtctagtgctggttgacaaaactaccgggtctagttacaacgctcgtggactcgccgggaggaaatatctattgccggcgatgtgggatccacagacgtcgacttgcaagactctggtttgatccaagggatgtgagtatgacacgtgtcatgttctggaaggaatgaggagatctagatgacatctatagtcaaaacaagttgtaactcgcgcttgtataatatatgctttcgggtttggactgtggataagagtctttgcttttgtcgttttgttgtgacgtgtaaattatgtttcttgaatgtgaagatatatgaatagtataaaataaaatgattttgtttctgttgaccaaaaaaa

SEQ ID NO: 239 - DNA, 1692 bp, Solanum tuberosum
cttacttcctcttgtgtgtaaacttaacaaatatcaaaaaaatatatacattgaatttattctcaattttttttttctataatggctgggatgtgttgtggggttaatatagctgaaactgaggctactgcaccagttgagccaagttcagaagctgcaaggagaagaagaatgggaattcatcagttccgttttgtacccaccgatgctgcagctgtttcagctgcagcatcggtggcggtgcaggaaaatggacggaaaaggcataggattgagaaagttattgataataaaaagagacagaaattggaaactagtgtgacgatttcgttgtcacctccgccggtggcggtggtggtggcggatgaacagaaaggaaaggataatgaagtgttggatctgtcggaatctggttctcaatctgttgaaattgagcctgatttacccaaatttggtgcgacttcggtatgtggaagaagaagagatatggaagatgcggttgcaattcatccttctttttgcaaagagaatagtgaaagctcaagcaatttacatttcttcggtgtttacgatggccatggctgttcccatgtggcgatgaagtgtaaagatcgaatgcacgagatagtgaaaaacgaggtggagaaggaagaaactccatggaaagaagcaatgattcagagcttttctctaatggataaagaagttgtcaactattctagcacacttcgatcttctacctcaggttccaattgtagatgcgagcttcagactccacagtgcgatgccgttggatcaactgctgtcgttgccgttgtaactccggacaaaatcatcgtctccaattgcggtgattctcgtgccgtcctctgtagaaacggcgtcgctattcctctttccgttgatcataagccggatcgacctgatgaattgaatcggatacaagaagccggtggccgtgttatatattgggacggagctagagttctcggcgttttggcaatgtctcgagcaattggcgacaattatttgaaaccatatgttatatcagaaccggaggtgacgataacagatcgaaccaacgaagacgagtgtttgatattagccagtgacggattatgggacgtggtatcgaacgagaccgcgtgtggcgtggcacgtatgtgtttgcaatcgagacggccaccgtctccggcgggttcgccgggaaatgacattacggtgaccggcgccggagaaagctccgacaaggcctgttcagatgcatcaattctgttgacgaaattagccttggctaggcacagtagtgataatgttagtgttgtggtggtggatttgagaaaaaatgtataacattatgatggtgattagtactagttttaattttaattaattaatcaagtgtataattaaggggaaactctaattttaggttttaattagcatgggttgtgctaatgaagctaagattgaagatgatgttttgatttattagtttagctgatttagctgcctatgttgatgattagtaatgctaattattattattattattattactatattttagagaaatggagatggaaattgtaaagaggtggatcttctctccaactgtcccagattttatgtgaaatatagaaaatacaaaatcatattttaaattttgtttattattattgtaattactgg

SEQ ID NO: 240 - DNA, 1551 bp, Solanum tuberosum
ttatgagttatgagtcttacttcgtgttgtgtgtaaacttaacaaatatcaaaaaaatatattcattgtattcattctcaatttttttttactataatggctgggatgtgttgtggggttaatatagctgaaactgaggctactgcaccagttgagccaagttcagaagctgcaaggagaagaagaatgggaattcatcagttccgttttgtacccaccgatgctgcagctgtttcagcggtggcggtacaggaaaatggacggaaaaggcataggattgagaaagttattgaaaataaaaagagacagaaattggaaactagtgtgacgatttcgttgtcacctccgccggtggcggatgaacagaaaggaaaggatatcgaagtgttggatctgtcggaatctggttctcaatctgttgaaattgagcctgatttacccaaatttggtgtgacttcggtatgtggaagaagaagagatatggaagatgcggttgcaattcatccttctttttgcaaagagaatagtgaaaactcaagcaatttacatttcttcggtgtttacgatggccatggctgttcccatgtggcgatgaagtgtaaagatcgaatgcacgagatagtgaaaaacgaggtggagaaggaagaaactccatggaaagaagcaatgattcagagcttttctctaatggataaagaagttgtcaactattctagcgcactccgatcttctacctcaggttccaattgtagatgcgagcttcagactccacagtgcgatgccgttggatcaactgctgtcgttgccgttgtaactccggacaaaatcatcgtctccaattgcggtgattctcgtgccgtcctctgtagaaacggcgtcgctattcctctttccgttgatcataagccggatcgacctgatgaattgaatcggatacaagaagccggtggccgtgttatatattgggacggagctagagttctcggcgttttggcaatgtctcgagcaattggcgacaattatttgaaaccatatgttatatcagaaccggaggtgacgataacagatcgaaccaacgaagacgagtgtttgatattagccagtgacggattatgggatgtggtatcgaacgagaccgcgtgtggcgtggcacgtatgtgtttgcaatcgggacggccaccgtctccggcgggttcgccgggaaatgacattacggtgaccggcgccggagaaaactccgacaaggcctgttcagatgcatcaattctgttgacgaaattagccttggctaggcacagtagtgataatgttagtgttgtggtggtggatttgagaaaaaatgtataacattatgatggtaattattactagttttaattttaattaattaattaagtgtataattaaggggaaactctaattttaggttttaataattagcatgggttttgctaatgaagctaagattgaagattatgttttgatttattagtttagctgatttagctgcctatgttgatgattagtaatgctaattattattattattat

SEQ ID NO: 241 - DNA, 958 bp, Raphanus sativus
ggattcttcactctgactttgtctgaaaactagatctctctctctctctcaatggcttctcctcttctcccaacttcaacttctcctgatcacctcccaggtggtagtgatccacagttactaagctctctacgcgtcctcgtttcccgcgttctagcctccgcccgtcacgctacttccgacgctcggccctggacagagctcatcgaccggtcagcgttctcacggccaccatctctctccgaggcagcgtcgcgtgtaagaaagaacttctcctacttcaaatccaactacataaccttagtagcgatcttgctcgcggcctctctcctctcacaccctttcgcgctcatcctcctcgcgtcccccgccgcttcttggcttttcctctacgtgttccgtccctcggatcagccgttggtcatcggaggacgcacgttctctgacctggagacgctggggatgctctgtctttgcaccgtggtggtgatgttcatgacgagcgtcggttcgctcttgatgtctacactggctcttgggacgatggctgtggccgtgcacggcgcgttccgtgcgcctgaagatctgtttcttgaggagcaagaaaccattggatctggtctttttacattctttaaccaaaatgcttcgaacgcggcagctgctgctattgctacatccgctatgtcacgagttcgagcctgataagcttaataacattaccattttccaacagatatacgttatactattgatttattcactcctttcgttttatactcatatatttcattttgtatgtatcctcgacawtttktgttgatgtaataaaattttctaaacgtgtttaaggagtatttaactatctttgtttatgttgctcttttacaccaaagtgaaactgtgtaaagcccaaaaccatatgagtaaaagaataagaagaagaaaattacaggca

SEQ ID NO: 242 - DNA, 797 bp, Antirrhinum majus
  misc_feature (728)..(728): n is a, c, g, or t
ctgggcaggtgaaaactaactccatcactgatccaaaacggctccactccgatccgttaaattatacacacaaacaagttcagtgaaaatcgccgtcaacaaacgggtcggatcggctttggatccgaatgactggagatctgaatatggacgtgctacaggaatctggctgggaggagcttcgtaaagaggctcggaaaatcgaaggcgatctcgatgtgaaactctcttcttacgctaagctcggagctcgattcacacaaggaggctttgtggatgctgcttcaccaacccttggatccagcaggtcatggaagtccatggatgtggagattcaggcattgcttgagaaactgctggacataaacgattcaatgagtcgatgtgctgcatctgctgctcctactacttcagttactcaaaagcttgccagacatagagacatattgcatgagttaacccaggaatttagacgtatcaagggaaatattaactcaatgagggaacatgcggaacttcttagttccgtgcgagatgatatcagtgagtacaagacttctgggagtttatcaccaagaaaccagctacttcgagaaagagcttccatacacggaagcatatctcatattgatgatgtgattggccaagctcaagcgaccagagccgtcttgggttctcaaagggccttgtttggagatgtccaaggaaaggtcaagcaactcggtgancaatttccggtcattcgtggcctacttggttcaatcagaagggagaaatcaagagatactctcatccta

SEQ ID NO: 243 - DNA, 1043 bp, Malus domestica
cacgaggctcatctctctcagcaccaagcagacactgtgaataacttgaaaatgtttttcaactgtaaataactgaatcagtagagagccacggttggatcacgacgcagtcacggaagacgaattggccaaaagggttgccgaatcccgatccgcaattcggagatccaaatgacggattcgaatctggagttgcaggaatcgggttgggaggagctgaggagggaggccaggaagattgagggagatcttgatgtgaagctctcttcttacgctaagcttggtgctaggttcactcaaggaggttatgtagattctgggtcaccacctgttagttcgagcaggtcatggaagtccatggaaatggagatcgaatctttgctagagaaacttttggatatcaatgattcaatgagtcgatgtgctgcatctgctacaccagctacttctgtaactcagaagctagcaaggcatagagacatacttcatgagtttacccaggaatttagaagaatcaaggggaacataaattcattgagggaacatgcggagcttctgacttcagtcagggatgatatcagtgagtacaaggcatcggggagtatgtcaccaagaatgcaaatactacgggagagagctgccatccacggaagtgtatctcatatagatgaggtgattagtcaagctcaaacaacaagggcagtcttgggctctcaaagggctctgtttggagatgttcaarggaaagtgaaaaatctaagtgacaagttccctataatccgcggcctacttggttcgattcgaaggcggcgatcaagagacacgcttattctgtctgcagtcattgcarcttgtaccttgtttcttattatctactggctttcaaaataaatatacgaatgagatatgtcatacagaaagttataaacgatggtacctctctagggaattttgcttctgtaatttcttgggacaaattgtttatatatttcaaaagttggtggtgcctattttgtggtgccattccaatgaaaaaaaaaaaa

SEQ ID NO: 244 - DNA, 925 bp, Prunus armeniaca
ggcacgagcggcacgagagagaatgcaaagctgagtgtgaagaactgaaaacctgaaaatggtttttaactgtaaataacggaacctgtactaacaattggatcaacagtcacagaagataaattagtaaaaagggttgttgttgaatccggatcaggaattgggagatccaatgacgacagattcgaatctggagttgcaggaatcgggttgggaggagctgaggagagaggccaggaagatcgagggagatcttgatgtgaagctctcttcttatgctaagctcggtgctaggttcacacaaggaggttacgtggaatctgggtcaccttctgtcgggaccagtaggtcatggaagtccatggaaatggaaatccaatctttgcttgagaagctcttggacataaatgattcaatgagtcgatgtgctgcttctgctacaccagctacgtctgtgactcagaagctagcaaggcacagagacatacttcacgagtttacccaggagttcagaagaatcaaggggaacataaattcattgagggaacatgcggagcttctgacttcagtcagagatgatatcagtgagtacaaggcatctgggagtatgtcaccaagaatgcagatactacgggagagagctgcgatccatggaagcgtatctcatatagatgaggtgattagtcaggctcaaacaacaagggcagtgttgggctctcaaagggctttgtttggagatgttcaagggaaagtgaaaaatctaagtgacaagttccctattatccgtggcctacttggttcaattagaaggcggcgatcaagagacacccttattctcgctgcggtcattgcagcttgtaccttgtttcttattatctattggctttcaaaataagtatacaaatgagttgttgaattgatacaa

SEQ ID NO: 245 - DNA, 1033 bp, Aquilegia formosa
gagaagagaagcaagagagagagagagagagagagagagagagagagagagcattcgaactgcattggaaagaatttcgaactgtaataacaaaagggttgtaagagagaagaagaagaagaagaagattaatagatcaaagaggggagaattgattgttgtgtttatcttcatttctaagtaataagaataataataagaaaatggatgtaaatctagagttacaagaagctggttgggaagaattaaggaaagaagctcgaaagatcgaaggagatcttgatgttaaactttcttcttatgctaagctcagtggaaggttcacccaaggaggttatgcagaaactgggtcaccaactgttggttccagtagatcatggaaatctatggaaatggaaattgaatccttacttgagaagttacaagataccaatgattccatgagccgatgtgctgcatctgcaacaccagctgcttccatttcccagaagctagccaggcacagagacatacttcatgagtttatacaggaatttaggcgaatcaagggaaacataagctccatgagggagcatgctgaacttctcagttctgtcagggatgacatcagtgaatccaaggcgtctgggagtatgtcaccgcgaatgcagttattaagagaaagagctgccatacatggaagcgtagcccatattgatgatgtgataagtcaagctcaaacgacaagggctgttttgggatctcaacgtacaatgtttggtgatgttcaagggaaagttaagcagctgagtgacaagttcccaataatccgtggccttcttggtgcaatcaaaaggaagcgttctagagatactctaatcttggctgcagtcattgcagcttgcactctgttccttattatctactggctttcgaagtaaagagagatgatgacagcaaaagggaaaactggagatgacaggactttgtagaaattttttgcttccactatatgattgtaatagtttactcatcttgtctgaagtctttgcct

SEQ ID NO: 246 - DNA, 624 bp, Brassica oleracea
gggagatgacggaatcgagctgggatctacaggaatcaggttgggaggagcttcggagagaagctcgcaaaatcgaaggcgatctcgacgtgaagctctcctcttacgctaaactcggcgccagatccactcaaggcgggtatgttgacgccgggtctccaagatcatggaagtccatggagattgagattcaatcttcgcttgagaagctgttggacattaacgattccatgagtagatgtgctgcatctgctgcatccacaacctcggttactcaaaagcttgcaaggcacagagatatacttcatgaatacacccaggagtttcgaaggataaaaggaaatataaactccatgagagaacatgctgagcttttgagttctgtcagggatgacataagtgaatataaggcttctggtagtatgtcaccaggtgtgcaagtcttaagggagagagcttcaatccatggaagtatttctcatattgatgacgttattggtcaagcycaagcaacaagagcagttcttggctctcaacgatctctgttttcagatgttcaagggaaagttaaaaatctcggagacaaattcccagtgattcgtggcttacttggttcaattagaa

SEQ ID NO: 247 - DNA, 862 bp, Brassica rapa
tcgaaaaaaaaaagaagaagaagaagaagaaggtgatcggatctaaaaccgacgaagatcggagatggcagaatcgagcctggatctgcatgaatccggctgggaggagctccgtagagaagctcgcaaaatcgaaggcgatctcgacgtcaagctctcctcctacgccaagctcggcgccaggttcaatcaaggcggttatggtgttgatggtggatctcctggaggatcatggaagtctatggagattgagatacaatcttcgcttgagaagctgttggatattaatgattccatgagtagatgtgctgcctctgctgcacctacaacctctgttactcaaaagcttgctaggcatagagacattcttcatgaatacactcaggagtttcgaaggataaaaggaaacataagctcgatgagggaacatgctgagctcttgagttctgtcagggatgacataagtgaatataaggcttctggtagtatgtcaccaggtgtgcaagtgttaagggagagagcttcaatccatggaagtatatcccatattgatgaagtcattggccaagctcaagcgacaagagcagttcttggctctcaacgctctctgttttcagatgttcaagggaaagtgaaaaatctcggagataagttcccagtgattcgtggcttacttggttcaattagaagaagacgatctcgggacacacttatcctctcagctgtcatcgctgcttgtaccttgtttataatcatctactgggtctcgaaataaacagtaatgttcatatacctaaaagcccattaagacgatcctctatccgatttttccaagttttttttttttgtattttgccgtttt

SEQ ID NO: 248 - DNA, 850 bp, Ocimum basilicum
gacgccgtagctggtcggatcctttagatccgaatatggatgcgtcctaggaatccggttgggaggagctccgtcgagaagctcgcaagatcgaaggcgatatcgatgtaaaactctcatcttatgctaagcttggcgctcgcttcacccaaggagggaatatggatgttgcttcaccaactcttggatccagcaggtcatggaagtctatggaaatggagattcagtctttgctggagaaactacttgacataaatgattcgatgagtcgatgtgctgcgtctgctgcacctactacttcagttactcaaaagcttgctagacacagagacatactgcacgaatttacccaggaatttaggcgaaccaagggaaatatcaactcaatgagggaacatgctgaacttcttagttctgtacgcgatgatatcagtgaatataaggcctctgggagtgtgtctccaagaatgcagttactacgggaaagagctgctatacacggaagcatatctcatattgatgatgttattagtcaagcccaatcgacgagagctgtyttgggctcgcaaagggccctatttggagatgttcaaggaaaggttaagcaattaggtgacaagtttccagtcatccgcggcctaatcggttcaatcagaaaaaaacgatcaagagatactctcatcctatctgcagtcattgcagcttgtacgctttttctcatcatctattggctatcaaagtgaccacatttttagatatcaatagtaacaaggaatttagctttcatgtacaatatgttcccctagaaaataaaatataggaacaagtcaaaagggagttcaccatccat

SEQ ID NO: 249 - DNA, 1023 bp, Phaseolus coccineus
tggccggggggcgaactccaattaccgatctctgaactgaaataaccaaaatccgctccccgagaaagatccgaatgagggatccgaatctggagttgcaggaattgggttgggaggaactgcgtaaggaagcgcgcaagatcgagggcgatcttgacgtcaagctctcttcctacgccaaactgggcggtcgcttcacgcaaacaggtcatgtggatagtggttcaccacctcttgggtccagtaggtcttggaagtccatggaaatggaaatccaatctttgcttgagaaactgttggacataaatgattcaatgagtagatgtgctgcatctgccggaccagctacatctgtaactcaaaagttggctaggcacagagacattcttcatgactttacccaggaatttaggcgtatcaaggggaacattaactcaatgagggaacatgcagagcttttgagttctgtcagggatgatattactgactttaagacatccggcagtatgtctccaagaatgcagttgctacgggagagggctgccatccatggaaatatatctcatatagatgatgtgattagtcaagctcaagcaacaagagctgtgttgggttctcagagaaccttgtttactgatgttcaaggaaaagtgaaaggtcttggtgacaagttccccatgattcgaagccttcttggttcgataagaaggcggcgttcaagggatactcttattctgtcagcagtaattgctgcttgtacgttgtttctcatcatttattggctttcaaagtgaccaaaatattttgtaacacattatgaattatggtacttctatccattgaatttttccgcttctgtctgttttttttttatctttttgtttttaggggagggggagagtaggattttttttttcaatccactgtctaggagcctcatatttgtatgtcagttgttgacattaaaaagatttatttgatttttttttatataaatcagtatcaaatagtaaattctacatt

SEQ ID NO: 250 - DNA, 1083 bp, Theobroma cacao
cggggaagcagaagaacaaaatcaagtagtcccagcacccagcagcattttcatttctccaattgaatgagggtaactaactgtaataactgaaccaatctccaccgttggatccacataagaacacaacgccaataagagggagaagctgaaaagtgcgagcgatccgaatttgaagaacgaagatccaaatgacggatccgattctggatctacaagaatcgggttgggaggaactgaggcgagaagctcgaaagatcgaaggcgatctcgatgtcaaactctcttcttatgctaagctcggtgctaggttcacccaaggagatactggttcgccaacggttggttcaagcaggtcatggaagtctatggaaatggaaattcaatcattgcttgagaaactgctggatacaaatgatgctatgagtagatgtgctgcatctgctgcaccgactacttcagtgacacagaagcttgcaaggcatagagacatactacatgagtttactcaggaatttagaagaatcaagggaaatataaattcaatgagggaacatgcagagcttctgagttctgtcagggatgatatcagtgagtataaggcatctgggagtatgtcaccgagaatgcagttactcagagagcgggcagccatccatggaagcatagctcatatagatgatgtgatcaatcaagctcaaacgacaagggcagtgctgggctcccaaagagctttgtttggagatgttcaagggaaagtaaaacttctaagtgacaagttccctgttatccgtggcttgcttggttctatcagaaggaggcgttcaagagacactcttattctgtctgcagtaattgcagcttgtacgttgttcctcattatttattggctctcaaagtaactagagatgccattttactaatacccaaatgttgaaagtggttgtgttttgctaagagaattttgcttataatttgttagaacagatcaaatatytctgtagytatgcttgmycacagaaaactttcatctttgtttcatatgcaaatctattcattgctccgacacagaggtttggtgga

SEQ ID NO: 251 - DNA, 926 bp, Brassica napus
gagaagaagaagaagaagaagaagaagaaggtgatcggatctgaaaccgacgaagatcggagatgacggaatcgagcctggatctgcaggaatccggctgggaggagctccggagagaagctcgcaaaatcgaaggcgatctcgacgtcaagctctcctcttacgccaagctcggcgccaggttcaatcaaggcggttatggtgttgatggtggatctcctggaggatcatggaagtctatggagattgagatacaatcttcgcttgagaagctgttggacattaatgattccatgagtagatgtgctgcctctgctgcacctacaacctctgttactcaaaagcttgctaggcatagagacattcttcatgaatacactcaggagtttcgaagaataaaaggaaacataagctcgatgagggaacatgctgagctcttgagttctgtcagggatgacataagtgagtataaggcttctggtagtatgtcaccaggtgtgcaagtgttaagggagagagcttcaatccatggaagtatatcccatattgatgaagtcattggccaagctcaagcgacaagagcagttcttggctctcaacgctctctgttttcagatgttcaagggaaagtgaaaaatctcggagataagttcccagtgattcgtggcttacttggttcaattagaagaagacgatctcgggacacacttatcctctcagctgtcatcgctgcttgtaccttgtttataatcatctactgggtctcgaaataaacagtaatgttcatatacctaaaagcccattaagacgatcctctatccgatttttccaagttttttttttttttgtattttgccgttttgttgagttgtgtttgtactttgtagtaatgttacattcttaatcataaaaagcttaaaattttc

SEQ ID NO: 252 - DNA, 1307 bp, Brassica napus
gaaacattggtggagacgatgacagaatcgagcttggatctacaggaatcaggttgggaggagcttcggagagaagctcgcaaaatcgaaggcgatctcgacgttaagctctcctcttacgctaaactcggcgccagattcactcaaggcgggtatgttgacgccgggtctccaagatcatggaagtccatggagattgagattcaatcttcgcttgagaagctgttggacattaacgattccatgagtagatgtgctgcatctgctgcatccacaacctctgttactcaaaagcttgcaaggcacagagatatacttcatgaatacacccaggagtttcgaaggataaaaggaaatataaactccatgagagaacatgctgagcttttgagttctgtcagggatgacataagtgaatataaggcttctggtagtatgtcaccaggtgtgcaagtcttaagggagagagcttcaatccatggaagtatttctcatattgatgaagttattggtcaagctcaagcaacaagagcagttcttggctctcaacgatctctgttttcagatgttcaagggaaagttaaaaatctcggagacaaattcccagtcattcgtggcttacttggttcaattagaagaagacgttctcgggacacacttatcctctctgctgtgattgctgcttgtacgttgtttctaatcatctactggctctcgaaataaacagtattgttcatacacctaaagtataagaagagcttattaatttttttccaagtcttttttcttcttcttgcttttgtattttgctcggtttatgtgtttgtaggatataatgttacactcttaatcataaaacagcttaaagttcgagaaaacacattttaacaggatcaatccatgtgacagcagtcaggttataaaatctaaagggtggggacacacttcactgatgatgatgatccagtccttatgtttgtctcactactcatgccctacatatagtttcaagaaatgttaattagtttgttcataccggtttagagatattgtggtggtggtttctaaaaaaaaagatattgtggtggtccagagcctttatatggacttggtccagctttgtcagggccagggccaagtcgatttttctatgtaaattaaattatgctaggattaggttggattttaatcctaaagaaattgtcaatgtgtatgtctatcagaagcatatagtctcgtgtaacatctgtatttaaatatagattaatgattattgattaagatgtggttatggcaaaaaaaaaaag

SEQ ID NO: 253 - DNA, 774 bp, Brassica napus
agaagaagaagaagaaggtgatcggatctgaaaccgacgaagatcggagatgacggaatcgagcctggatctgcaggaatccggctgggaggagctccggagagaagctcgcaaaatcgaaggcgatctcgacgtcaagctctcctcttacgccaagctcggcgccagattcaatcaaggcggttatggtgttgatggtggatcacctggaggatcatggaagtcgatggagattgagattcagtcttcgcttgagaagctgttggatattaatgattccatgagtagatgtgctgcctctgctgcacctacaacctctgttactcagaagcttgctaggcacagagacattcttcatgaatacactcaggagtttcggaggataaaaggaaacataagctcgatgagggaacatgctgagctcttgagttctgtcagggatgacataagtgaatataaggcttctggtagtatgtcaccaggtgtgcaagtgttaagggagagagcttcaatccatggaagtatatcccatattgatgaagtcattggccaagctcaagcgacaagagcagttcttggctctcaacggtctctgttttctgatgttcaagggaaagtgaaaattctcggagacaagttcccagtgattcgtggcttacttggctcaattagaagaagacgttctcgggacacacttatcctctccgctgtcatcgctgcttgtaccttgtttataatcatctactggctctcgaaataaacagtatgttcata

SEQ ID NO: 254 - DNA, 854 bp, Cichorium intybus
taaagtgtgaacaaaatagagtagaagagcagcaaagcaacacagatttgcttccatttctactgaaaattcgtctacaatcacaaaagcatcaacacaaaccgacaataagggtttagcggatcagatccaagtagaatcgggctgaagagagtgtatgatggatcaggaatcgggttgggaagaactgaggaaagaagctcgtaagatcgaaggcgatcttgatgttaagctctcttcgtatgctaaactcggcgctcgtgtcactcaaggaggctttgcagatacagatacaccaactatgggctctaacctcatggaagtcaatggagatggaaatacagtcattacttgagaaattattggatgtgaatgattccatgagtagatgtgctgcatctgcaacacctactacttcagttacacagaagctagcaaggcacagagatatacttcatgaatttagccaggaattcagaagaatcaaaggaaacataagtgcaatgacagagcatgctgagcttctaagttctgtcagagacgatatcagtgagtacaaggcatccggaagcatgtccccaagaatgcagatactaagggaacgagctgctatccatggaagcattgcacatatggatgatgtgataactcaggctcaaacaacaagggcagccttggggtctcaaagggctatgtttggtgatgttcaagggaaagttaaacaactaagtgacaagttccccatagttcggggactaattggttctattagaaggaagaaatcaagggatactctcatactatcggctgttattgcggcttgtacgttgtttctcattatatattggctttca

SEQ ID NO: 255 - DNA, 1121 bp, Citrus sinensis
gttccttcctgctcctgagawagagagttaagacgacagagtaactagagccccatatggtggtggtgcaggtgcgctgagaacttcaaatttcaactgtaataaccgaatcaatctccgccgttggatcaccgaaagaattgaaactataaccaggatctgtaattgaaatccgaatatccaaatgacggatccgaatctatatctacaggaatcgggttgggaggagctgagaaaggaggcacgtaagatcgagggcgatctcgatgtcaaactctcttcttacgctaagcttggcgccaggttcactcaaggaggttatgtagatacagggtcgccaactgttgggtctggcaggtcatggaagtccatggaaatggaaatccaatcattgctcgagaagctacttgatataaatgatgcaatgagtagatgtgctgcatctgctgcaccaactacttctgtaactcagaaacttgcaaggcatcgcgacattcttcatgaattcacccaggaatttagaagaatcaagggaaacatcaactcaatgagggaacatgcggagcttctgagttccgttagggatgatatcagtgagtataaggcatcrgggagtatgtcaccaagaatgcagatattacgagagagagctgccatacatggaagcataacwcatatagatgatgtgattagtcaagctcaaacgacaagaacagtccttggctctcaaagggctttgtttggagatgttcaagggaaagtgaaggttctaagygacaagttccctattattcgtggcctacttggttcaatcagaaggcggcgttcaagggacactcttattctggctgcagtyattgctgsttgtacgttatttcttattatctattggctctcaaagtagcagaaagatgtgatttattgatagatggaattmtaaaatgatggtgcttttgcataggaattttgcttatgtaagctataagtatgacaaatcaatttccttttttataaaccttgtggcatcaatctttggcgccattatcccgaaaaatgaataagaatctaattcaattcaaaaaaaagggggccctgccccccccccccccaacccccccccc

SEQ ID NO: 256 - DNA, 1371 bp, Gossypium hirsutum
cttaatacaatcactacaatatgctctgtacgggtaccctagaacatcctctscctctctttctcwmtckgytgaggctgragctgattgaatcagaacyggacamcaaaattatagaaatccaagtcatmaaagctaagcagcgaaaaggaggaawgaaaagaacaacgcactcaacggcattttcatgtatccaattcaatgctcattaactgtaatctccatcactggacttacattacaactcagcgccagggcaattgaactaccgacatccaaatgacggatacgaatctggatctacaagaatcgggttgggaggaactgaggaaagaagctcgaaagatcgaaggcgatctcgatgttaaactctcttcatatgctaagctcggtgctaggttcacccaaggagatactgggtcgccaacgcttgggtcgagtagatcatggaagtctatggtaattgaaattcaatcattgcttgagaagctgctagacataaatgatgctatgagtagatgtgctgcatctgctgcaccaactacttcggtaacccagaaacttgcgaggcatagagacatactacatgagtttactcaggaatttaggagaattaagggaaatataagctcaatgagggaacaggcagagcttctgagttctgtcagagatgatatcagtgagtttaaggcatctgagggtatgtcaccaagaatgcaattacttagagagcgagcggccatccacgggaacatagctcatatagatgatgtgattaatcaagctcaaacgacaagggctgtgttgggctctcaaagagctttgtttggagatgtccaaggcaaagtaaaagttctaagtgacaagttccccgttatccgtggcttgcttggttccatcagaaggaggcgttcaagagacacacttattttatcagccgtaattgctggttgtacgttgttccttattatctattggctctcaaagtaactagagatacgagttattaatagggtaatgttcaaagtggaaggtttggctttgctgagagaattttgcagtataatttgttagaaccgatcacattccctgttaagcttgaggtaccttctttttggtgccattacatagaaaatcacatttttatttaatgtgcaagtcagttgcattgctcaatcatagacgggtgctaaaccgggggtatcatattgagttttttcgaattcatattttgttcggctcaaatcctttcggattcgattctttcaggcttggactttttagatttagattagttcaagctaggtgggttttgatggattcaaataatcttgaattttctaagttataaatattttaattttgaatgta

SEQ ID NO: 257 - DNA, 1027 bp, Gossypium hirsutum
gagaaacagaaaatcaaaattgacgatcatcgaacataaagaaagcaagtaagcttccaacactcagcagcatttttgaattctgtaattggatgagggttactaacctgaaataactcaaccaatctccatcgttggatccacataagaaacgaaactagagccagggatccgaatttcaaacaccaagatctaaatgacggatccaaatctggatctgcaagaatcgggttgggaggaactcaggagagaggctcgaaagatcgagggtgatctcgatgtcaaactctcttcttatgctaagctcggtgctaggttcacccaaggagatactgggtcgccaaccgttgggtcaagtagatcatggaagtctatggaaatggaaattcagtcattgctcgagaaactgctggacataaatgatgccatgagcagatgtgctgcgtctgctgcttcaactacttcagtaacccagaagcttgcaaggcatagagacatactacatgagtttactcaggagtttagaagaatcaarggaaacataaatkcartgagggaacacgcggagcttctgaggtctgtcagagatgatattaatgagtataaggcatctgggagtatgtcaccgagaatgcaattactcagagagcgagctgccatccatggaagcataggtcatatagatgatgtgattaatcaagctcaaacgacacgagcagttttgggctctcaaagagctttgtttggagatgctcaagggaaagtcaaagttttaagtgacaaggtccctgttatccgaggcttgcttgggtccatcagaaggaggcggtcaagggacactcttattctgtcagcagaattgctgcttgtgcgttgctccttattatyyattggctctcaaagtgactagggatggaattsatattaatataccaatgttgawagctgctgtgtgtcggttagagacttttgcttatggatwssgtgaacagatcacattmtgtgtgtcgccttggcattgcaatca

SEQ ID NO: 258 - DNA, 853 bp, Vigna unguiculata
ggacggttgcgaactccattaactgaatctctgaaccgaaataacgaaaatctgctccccgagaaagatccgaatgagggatccgaatctggagttgcaggaatcgggttgggaggaactacgtaaggaagcgcgcaagatcgagggcgatctcgacgtcaaactctcttcctatgccaaactaggcggtcgcttcacgcaaacaggtcatgtggatggtggttcaccacctcttgggtccagtaggtcttggaagtccatggaaatggaaatccagtctttgctggagaaactgttggacattaatgattcaatgagtagatgtgctgcatctgccggaccggctacttctgtaactcaaaagttggctaggcacagagacattcttcatgagtttacccaggaatttaggcggatcaaagggaacataaactcaatgagggaacatgcagagcttttgagttctgtcagggatgatattacggactttaagacatcgggcagtatgtcaccaaggatgcagttgctacgggagagggctgccatccatggaaatatatctcatatagatgatgtgattagtcaagctcaagcaacaagagctgtgttgggttctcagagaaccttgtttactgatgttcaaggaaaagtgaaaggtcttggtgacaagttccccatgattcgaagccttcttggttcgataagaaggcggcgttcaagggatactcttattctgtcagcagtaattgctgcttgtacgttgtttctcatcatttattggctttcaaagtgaccaaaatattttgtaacgcattatgattatggtacttctatcaattgaatttttctgcta

SEQ ID NO: 259 - DNA, 968 bp, Taraxacum officinale
cagaatcaatactcccaatagaagtgtgatacaaaatagagtagcagagagcagcaaagcaacacagatttgcttccatttcaattttcaactggaatttcgtctacaaacaccatatcatcaacacaaatcgacgattgtggcggagtggatcggatccaagtagaatctggttgaaagaaagtgtatgatggatcaggaatcgggttgggaagaactaaggaaagaagctcgtaagatcgaaggcgatcttgatgttaagctctcctcttatgctaagctcggcgctcgtgtcactcaaggaggttttgcagatgctgatacaccaacaatggggtccaaccgttcatggaagtcaatggagatggaaatacagtcattacttgagaaattattggatgtgaatgattccatgagtagatgtgctgcatctgcagcacctactacttcagttacacagaagctagcaaggcacagagatatacttcatgaatttagccaggaattcagacgaataaaaggaaacattagtgcaatgacagaacatgctgagctcctaagttctgtaagagatgacatcagcgagtacaaggcatctggaagcatgtcaccaagaatgcagattctaagggaacgagctgctatccatggaagcattgcacatatggatgatgtgataactcaggctcaaacaacaagggcagccttggggtctcaaaggactatgtttggtgatgtacaaggaaaagttaaacaactaagcgacaggttccccatagttcggggtctaattgggtctattaaaaggaagaaatcaagggatactctcatcctatctgctgktattgcagcttggtacgttgtttctcattatatattggctttcaaagtgaacaaaaaaaaaatatagttatgtgtctattatcatgaaaatgtgaaaacaatgctctgtattccaatgaaatttt

SEQ ID NO: 260 - DNA, 1089 bp, Eucalyptus gunnii
cgggcgaggcggtggaagaggatctggcgcttacgagctagccacgtccgaagttcacgtcgggaaagcggagacggcggcggagtaagcgatcgtgcgggccgccggtggccgcccccccacattgcgccgtcgcggcgatccgaggaaggacgcgggagagcggcgtcggggagagctttccggtccgggaggatccggagcccgggggatccccgatggtgggcgatgcgagcctggagctgcaggaggccggctgggaggagctcaggaaggaggsgaggaagatcgagggcgatctcgacgtcaagctcaattcctatgcgaagctcggggccaggttctcgcaaggaggttatgtagacactgggtcaccaactgttgggtccagcaggtcatggaagtcaatggaaatggagatccaatcattgcttgagaaactattagacacaaatgaggctatgagtagatgtgctgcatctgctactcccactacctcagtaactcaaaagttggcaagacatagagacatccttcatgagtttacccaggagttcagacgtatcaagggaaacatcagctcaatgaaggaacatgcagaacttctcagttctgtgagggatgacatcagtgagtataaggcttctgggagtatgtctccacgagtgcaattactaagagaaagagcttcaattcatggaagcatatcccatatagatgatgtgattagccaagctcaaacaacaagagcagctctaggctctcagaggggtctctttggggatgttcaagggaaagtgaagctcttaagtgacaagttccctgtaattcgtggcatyctaggctcaataagaaggcggcgatcgagagacactcttattctctctgctgttattgctgcctgtacattgttccttataatctattggctctcaaaatagtaagaaagtgatatcatcgcagaaaaatcgggagttatctgctattttaggaattttgcttctgtatgtgctcsagcatattctttctttcggaccttgtgatacacggttgcaatttctgatattagtgaagattattcttgcattt

SEQ ID NO: 261 - DNA, 1095 bp, Vitis vinifera
agacacaggaagaaaaaaaggaaatgatttatagtagagttttcctttcacccaaaaaccagagacaagtacaatactgaacgaagaagaagcatacacaggtgtggaattgaattgagaattcccaactgtaataaccgtccattcaaagaggcaaaaagggaagaagacccagtgaggaagtgaggatccggatccgaaattcactaccccaatgatggatccgaatctggatttgcaggaatcgggctgggaggaactcaggaaggaggctcgtaagatcgagggggatcttgatgtgaagctatcttcttatgctaagcttggtgctaggttcacccaaggaggatatgtggacactggatcacccactgttagctccagcaggtcatggaagtccatggaaatggagatccaatccttgcttgagaagctacttgatacaaatgatgctatgagccgatgtgctgcatctgctgcacctactacttctgttactcagaagctagcaaggcatagagacatacttcatgagtttacccaggaatttagacggatcaagggaaacatgaactcaatgagggaacatgcagagcttctgagttctgtcagggatgatatcagtgaatacaaggcatctgggagtatgtcacctagaatgcagttactacgagagagggctgctatccatggaagcatatcccatatagatgatgtgattagtcaagctcaaacgacaagggctgccttgaactctcaaagaactttgtttggggattttcaagggaaagtgaaactattaagtgacaagttccctataatccgtggcctgcttggttcaatcaggaggcggcgatcaagagatactctcattctctctgcagtgatcgcggcttgtacgttgttcttgattatctattggctttcaaaatgaccagacatgcaatttattgttttggaactataacaattgtgctttcctagggaattttgcttctgtagttttgtgataacaaatcaagctcactgttttaacacttggtgatacccttttgtggtgccatcattcaacaaatttctttctgtttcataagc

SEQ ID NO: 262 - DNA, 1060 bp, Lactuca sativa
tagcaatagaagtgtgaaagaaaatagagcagtwgaagagcagcaaagcaacacagatttgcttccatttcaactgaaaattcgtctacaaaaccgacgagatargggttgagcggatcggatccaagtagaatcgggttggaaagagagygtatgatggatcaggaatcgggttgggaagaactgaggaaagaagctcgtaagatcgaaggcgatcttgatgttaagctctcttcttatgctaagctcggcgctcgtgtcactcaaggaggttttgcagatgctgaaacaccaacaatgggctccaaccgctcatggaagtcaatggagatggaaatccagtcattacttgagaagttgttggatgtgaatgattccatgagtagatgtgctgcatctgcagcacctactacttcagttacacagaagcttgcaagacacagggatatacttcatgaatttagccaggaattcagacgaatcaaaggaaacataagtgcaatgacagagcatgctgagcttctaagttctgtaagagacgatatcagtgaatacaaggcatctgggagcatgtcaccaagaatgcagatactaagggaaagagctgctatccatggaagcatatcacatatggatgatgtgataactcaggctcaaacaacaagggcagctttggggtctcaaagggccatgtttggtgatgttcaagggaaagttaaacaactaagtgacaagttccccatagtccggggactaatcgggtctattagaaggaagaaatcaagggatactctcattctatctgctgtcattgcggcttgtacgttgtttctcattatatattggctgtcaaagtgaaaaaggctaatgtctttatcatgaaaatgttaaaaacaatgttatattccatagaaattttgtccagtttgttattaaaattcacaactcggagacgttgtttgtgcattttttggacgtttactttcttattgttgagataatgagatagttatatgatgtatatccctgcttttggagggtgttatagtttatccaaaaa

SEQ ID NO: 263 - DNA, 863 bp, Cucumis melo
aattttgtagatggcaatgacggatcagagccttgagttgcaggagtccggttgggaggaactgaggcgtgaagctcgtaagatcgagggcgatctcgatgtcaagctttcctcctatgcaaagctcggtaccagattcactcaaggaggttatgtggattctggttcatcgtctgttggttccaacagatcatggaagtctatggaaatggaaatccaatctttacttgagaaattgttggatgttaatgattcaatgagtmggtgtgctgcatctgcaacaccagctacctccataaatcaaaaactagcaagacacagggatatcctccatgaatttacacaggaattcaagcgtatcaaaggaaacattaattcaatgagggaacatgcagaacttttgagttctgttagggatgacatcaacgagtataagtcacctggaaccatgtcyccgagagtgcrattactgagggaaagagctgctattcatggaagtattgctcatatggacgaagtaataagtcaagcccaaactacaagggcagtcttggggaaccaaagggttttgtttggagatgttcaaggaaaagtgaagcttctaagtgacaaattcccagttatacgtggccttctaggttccattagaagaaggcggtcaagggacacaattattctgtctggagtcattgcagcatgtaccttgtttctcattatctattggctctcaaaatgattaaaaaggtgcgaatttgaaaatttggagttttggttttgtaactcctttttctttgaagtaagcgacatggagatcgaagatttttagtgtttcttgtgcccttaaattcgaatatctttcttac

SEQ ID NO: 264 - DNA, 913 bp, Populus trichocarpa
gagtgggatgaagcatccaatacaagttcgagattatatatacataaataataaatccgtgaggataataaacagtgataccgttggagcacgaaacaaggcaatagcagtggtaggacccagattgtagttcgtgaggatcggatcggatcggatccaaaatgactgatccaaatctagagttacaagaatcaggttgggaagaacttagaagagaagcaagaaagatcgaaggagatctcgatgtcaaactctcttcttatgctaaacttggtgctcgatttactactcaaggaggaggttatgtggaaggtggttcgccaagagttggatccagtaggtcatggaaatcaatggaaatggaaattcaatcttcacttgagaagttacttgatataaatgatgctatgagtagatgtgctgctgcgtccgctgctacttcagttactcagaagctagcaaggcatagagatatacttcatgagtttacgcaggagtttagacgaatcaagggaaacataaactcaatgagggaacatgctgagcttctgagttctgtcagagatgatattagtgagtacaaggcttctggtagcatgtctccaagagtgcatttactacgagaaagagcagccatccacggaagcattgctcatatagatgatgttattaatcaagctcaaacgaccagggctgttttgggttctcaaaggactttttttggagatgttcaagggaaagtgaaggttctaagtgacaaattcccgattatccgtggccttcttggttctataaggaggcggcgatcgagagacacgctcattctgtctgcagtcattgctgcttgtacattgtttcttattatctactggctttcaaaataacgtacaaatgctgtttactgctacaaaac

SEQ ID NO: 265 - DNA, 930 bp, Populus trichocarpa
cgttagctcacgaaacaaaagaaatagcaagtattaggatctagatccaaaatgacggatacaaatctggagttacaagaatccggttgggaggaactacgaagagaagcaagaaagatcgaaggagatctcgatgttaaactctcttcttatgctaaacttggctctcgattcactcaaggaggaggaggaggaggttatgtcgagactggttcgccaacagttggatccagtaggtcatggaaatcaatggaaatggaaattcaatcgtcacttgagaagttacttgatataaatgatgctatgagtagatgtgctgcgtctgcagcaccagccacttcagttactcaaaagctagcaaggcatagagatatccttcatgattttacgcaggagtttagacgaatcaagggaaacataaactctatgagggaacattcagagcttctgagttctgtcagagacgatattagtgagtacaaggcatctggtagtatgtccccgagagtgcagttactacgagaaagagctgccatccatggaagcatatctcacattgatgatgtcataaatcaagctcaaacgaccagggccgttttgggttctcaaagggctttttttggagatgttcaggggaaagtgaagcttctaggcgacaaatttccaattatccgtggccttcttggttctatcaggaggagacgatcaagagacactctcattctgtccgctgttattgctgcttgtacgttgtttcttattatctactggctctcaaaataacaaatgctattaattgttacaaaatttacaaaacgatgatgctcttccaaagcaattttgcttctgtaatatgttgttaggatggatgaagttttgtatgcatcaatgtggtgccattacgccagaagtatatcattttgttttata

SEQ ID NO: 266 - DNA, 1011 bp, Solanum tuberosum
gaaaaaccagtgtgtgtaagcaattggagaaagggtgaatggtggcttctgctgaatccaaaaggggaaaaaacataaactctcaactgtaataactgtcagatcacaaactcaatttccccaatcggtaggaacgaaggattttccttacaagattgatcgggtcggatccgaatcagatccgtatgtctaaggatctgagtatggagatactgcaagaatctgggtgggaagaactacgcaaagaggctcgcaagatcgaaggtgatcttgatgttaagctctcttcttatgcaaagcttggtgctagggtcacacaaggaggttatgtagaagctggttccccaactttaggatccagcaggtcgtggaagtccacggaaatggagattcagtcattacttgagaaactactagatgtaaatgattctatgagtagatgtgcagcatctgcagcatctaccacttctgttacacagaaactggcaaggcacagggacatacttcatgaatttacccaggaatttaggcgtattaagggaaatataagctcaatgagggaacatgctgaacttcttagttctgtgagagatgatatcagtgagtataaggcatcagggagtatgtcccccaaaatgcatatactgagggagagagctgcactacatggaagcatatctcatattgatgacgtgattaaccaagctcaaacaactagggctgccttgggttctcaaagagctttatttggtgatgttcaaggaaaagtgaaacaactgggcgacaagtttcctgtcatccgcgggctaattggctcaattagaaggaagaaatcaagggatacactcattctatcagcagtcattgcagcttgcactttgtttcttattatctattggctctcgaagtaataggtatatctgttgatacaagaaaattcagaagacaatgatttctaaggaattttgcacttctagtcactgccatttccctgataagtgaaaaaaaaaa

SEQ ID NO: 267 - DNA, 972 bp, Prunus persica
ggcacgagcggcacgagagagaatgcaaagctragtgtgaagaactgaaaacctgaaaatggtttttaactgtaaataacggaacctgtactaacaattggatcaacagtcacagaagataaattagtaaaaagggttgttgttgaatccggatcaggaattgggagatccaatgacgacagattcgaatctggagttgcaggaatcgggttgggaggagctgaggagagaggccaggaagatcgagggagatcttgatgtgaagctctcttcttatgctaagctcggtgctaggttcacacaaggaggttacgtggaatctgggtcaccttctgtcgggaccagtaggtcatggaagtccatggaaatggaaatccaatctttgcttgagaagctcttggacataaatgattcaatgagtcgatgtgctgcttctgctacaccagctacgtctgtgactcagaagctagcaaggcacagagacatacttcacgagtttacccaggagttcagaagaatcaaggggaacataaattcattgagggaacatgcggagcttctgacttcagtcagagatgatatcagtgagtacaaggcatctgggagtatgtcaccaagaatgcagatactacgggagagagctgcratccatggaagcgtatctcatatagatgaggtgattagtcaggctcaaacaacaagggcagtgttgggctctcaaagggctttgtttggagatgttcaagggaaagtgaaaaatctaagtgacaagttccctattatccgtggcctacttggttcaattagaaggcggcgatcaagagacacccttattctcgctgcggtcattgcagcttgtaccttgtttcttattatctattggctttcaaaataagtatacaaatgagttgttgaattgatacaagaaagttataaattatgatgcctctttagggaattttaaaaaaaaaa

SEQ ID NO: 268 - DNA, 898 bp, Raphanus sativus
ggggtgatctgatcggatctgaaactgaacgaagatcggagaagatgacagaagcgagcctcgatctgcaggaatccggctgggaggagctccgtagagaagctcgtaaaatcgaaggcgatctcgacgtcaaactctcctcttacgctaagctcggcgccagattcaatcaaggcgggtatggtgttgagggtggatctccaggaggatcatggaagtcaatggagattgagattcaatcttcgcttgagaagttgttggacattaatgattccatgagtagatgtgctgcctctgctgcacctacaacctctgttactcaaaagcttgcaaggcacagagacattcttcacgaatacactcaggagtttcgaaggataaaagggaacataaactcgatgagggaacatgctgagcttctgagttctgtcagggatgacataagtgaatataaggcttctggtagtatgtcaccaggtgtgcaagtgttaagagagagagcttcaatccatggaagtatatcccatattgatgaagtaattggccaagctcaagcgacaagagcagttcttggctctcaacggtctctgttttcggatgttcaagggaaagtgaaaaatctcggcgacaagttcccagtgattcgtggcttacttggctcaattagaaggagacgttctcgggacacacttatcctctccgctgtcatcgctgcttgtaccttgtttataatcatctactggctctcgaaataaacagtattgttcatacacctaaagcctgttaagtctatccctatatagatttttccaaggtttttcttgccatttggttgagttatgtgttcgtaggatgtaatgtcacactcctaatcataaaacagcttaaaaattccaaa

SEQ ID NO: 269 - DNA, 936 bp, Raphanus sativus
gatcggatctgaaactgaacgaagatcggagaagatgacagaagcgagcctcgatctrcaggaatcyggctgggaggagctccgkagagaagctcgtaaaatcgaaggcgatctcgacgtcaaactcccctcttatgctaagctcggcgccagattcaatcaaggcgggtatggtgttgagggtggatctccaggaggatcatggaagtcaatggagattgagattcaatcttcgcttgagaagttgttggacattaatgattccatgagtagatgtgctgcctctgctrcaccwacaacctctgttactcaaaagcttgcaaggcacagagacattcttcacgaatacactcaggagtttcgaaggataaaagggaatataaactcgatgagggaacatgckgagcttttgagttctgtcagggatgacatcagtgaatataaggcttctggtagtatgtcaccaggtgtgcaggtgttaagggagagagcttcaatccatggaagtatatcccatattgatgaagtcattggccaagctcaagcgacaagggcagttcttggctctcaacggtctctgttttcggatgttcaagggaaagtgaaaaatctcggagacaagttcccggtgattcgtggcttacttggctcaattagaaggagacgttctcgggacacacttatcctctccgctgtcatcgctgcgtgtaccttgtttataatcatctactggctctcgaaataaacagtattgttcatacacctaaagcctgttaagacgatccctatatcgattttkccaactkkttttgtcwtgcmatttggttgagctatgtgtttgtaggatataatgtcgcactcctaatcataaaacagcttaaaaattcmaaacaaattattcgcaacatcaagatcaataatatccttacgacacca

SEQ ID NO: 270 - DNA, 846 bp, Carthamus tinctorius
cgggggagtaaagtgtgacacagaagtgagtagtararcgaagcagcacagatttactccaatctccactgaaaattcacacctaacaccatagcagcaacaagagaaggaggagcagaagggatcggatccaagtagaattgagagtgtgatggatcaggaatcggggtgggaagaactgaggaaagaagctcgcaagatcgaaggcgatctagatgttaagctctcttcttacgctaagcttggcgctcgtgtcactcaaggagggtatgctgatgctgatacaccaactattggctccaaccgctcatggaaatcaatggagatggaaatacagtcattactcgagaagttgctggatgtcaatgattctatgagtcgatgtgcggcatctgcggcacctactacctcggttacccaaaagctagctaggcacagggatatacttcatgagttcagccaggaattcagacgaataaaaggaaacataagtgcgatgacggagcatgctgagctcttaagttctgtaagagatgatatcagtgagtacaaggcatctgggagcatgtcaccaaggatgcagatactaagggagcgagctgctatccatggaagcatagcacatatggatgatgtaataagtcaggctcaaacaacaagggcagccttagggtctcagagggccatgtttggtgatgttcaaggcaaagttaagcaactaagtgacaagttccccatcgttcgtggactcattgggtcgattagaaggaagaaatcagggatacyctcatcttatctgctgtgattgcggcttgkactttgtttctcaatatatattggctttca

SEQ ID NO: 271 - DNA, 1114 bp, Glycine max
agctgcacacgatcctccctccttcgctctctacttcgttcgtccttctccaccctctcctcttctctgtttctgctctgttccactcgcgactcagagatcaaccacagctcgcttaaccgactatccgaactcttcgttgtaaccgaaatccggtgcacctataaagatccgaatgagggatccgaatctggagttgcaggaatcgggttgggaggagctgcgcaaggaagcgcgcaagatcgagggcgatctcgacgtcaagctctcctcctacgctaaactcggcgctcgcttcacccaaggaggttatgtggacagtggttcaccacctattgggtccagtaggtcttggaagtccatggaaatggaaatccagtctttgctcgagaaactgttggacataaatgattcaatgagtagatgtgctgcatctgctggaccggctacttctgtaactcaaaagttggctaggcacagagacattcttcatgagtttacccaggaatttagacgtatcaaggggaacataaactcaatgagggaacatgcagagcttttgagttctgtcagggatgatattactgactttaagacatcaggcagtatgtcaccaaggatgcagttactacgtgagagagctgccatccatggaagtatatctcatatagatgatgtgattagtcaagctcaagcaacaagagctgtgttgggttctcagagaacattgtttactgatgttcaaggaaaagtgaaggttcttggtgacaagttccccatgattcgtagcctgcttggttcaataagaaggcggcgctcaagggatactcttattctgtcagcagtaattgctgcttgtacgttgtttctcatcatttattggctctcaaagtaactattttgtaacacaaattatgaattatggtacttctgttcattgaatttttctgcttctgttatttttttccttttgttttttagagagggggaagagtaggatttttttttttcaatccactgtagaagcttcatatttgtatgtcagttggcattaagaaatttatttgactaagattttgatataaatcattatcgaatagcaaaatttcacatt

SEQ ID NO: 272 - DNA, 1032 bp, Glycine max
tcgcgacatagaaatcaatcacaacgcacttaaccgaatctccgaagcgttcgttgtaaccgaaatccggtgcaccgagagagatccgaatgagggatacgaatctggagttgcaggaatcgggttgggaggagctgcgcaaggaagcgcgcaagatcgagggtgatctcgacgtcaagctctcctcctacgccaaactcggcgctcgtttcacccaaggaggttcaggttatgtagatagtggttcaccacctattgggtccagtaggtcttggaagtccatggaaatggaaatccagtctttactcgagaaactgttggacataaatgattcaatgagtagatgtgctgcatctgctgggccagctacttctgtaactcagaagttggctaggcacagagacattcttcatgagtttacccaggaatttagacgtatcaaggggaacataaactcaatgagggaacatgcagagcttttgagttctgtcagggatgatattactgactttaagacatcaggaagtatgtcaccaaggatgcagttactacgtgagagagcttccatccatggaaatatatctcatatagatgacgtgattagtcaagctcaagcaacaagggctgtgttgggttctcagagaacattgtttactgatgttcaaggaaaagtgaaggttcttggtgacaagttccccatgattcgtagcctgcttggttcgataagaaggcggcgctcgagggatactcttattctgtcagcagtaattgctgcttgtacgttgtttctcatcatttattggctctcaaagtaactattttgtaacacaaattatgaattatggtacttctgtccattgaatttttctgctttgttattgttttccatttgttttttagagagggggaagagtaggatttttttttttcaatccactgtgtagacgcctcatatttgtatcagttgttggcattaaatttttttatttgactaagattttgatataaatcattatcaaatagcaaaattcc

SEQ ID NO: 273 - DNA, 835 bp, Euphorbia esula
  misc_feature (6)..(10): n is a, c, g, or t
gcaaannnnngtctccaaaactcaaattcagatcacaaamgatttaaatcagattaagaatgacggatcagagtctagaattgcaggaatcaggttgggaggaattaaggaaggaagctagaaaggctgaaggagatctcgacgttaaactctcttcttatgctaagcttggcgctaggttcactcaaggaggttatgtagatgctggttcacctactgttggaggtagcaggtcatggaagtccatggaaatggaaatacagtcattgcttgagaagcttttagacataaatgattctatgagtagatgtgctgcatctgcttctcccactacatcagttactcaaaaactagcaagacacagagacatacttcatgaatttacacaggaattcagacgtattaagggaaacataagctcaatgagggaacatgctgagcttctcagttcagttagagatgatatcagtgagtacaaggcatctgggagttcatctccaagaatgcagttactaagagaaagagctggaatccacggtagcattgctcatatagacgatgtcatcaatcaagctcaatcaacaagggctgtcttaggttctcaaagggctttctttggagatgttcaaggaaaagtgaagcttctaagcgacaaatttccagtcatccgtggcttacttggttctatccggaggcgaagatcaagagacactctaattctctccgctgtcattgcagcttgtacgttgtttcttattatctattggctctcaaaatgaaaaattgtgaattaattgtcacataatattgcactatgctattgatcttaaaagga

SEQ ID NO: 274 - DNA, 866 bp, Helianthus annuus
gcgggggatccccaaactatatcacatcctctaccagtagcwaagcaccactgtgttgcttccatytccatttcyatttcgactgcaaattcacctaacaaacacaatagcaatcacaawtcagatcggatccragtagaatcrtaagctttgatggatcaggaatcgggttgggaagaactgaggaaagaagctcgtaagatcgaaggcgatctcgatgtcaaactctcttcttacgcaaagctcggtgctcgygtcactcaaggaggttttgctgatcctgatacaccaagtatgggctccaaccgttcatggaagtcgatggagatggaaatacagtcgttacttgagaagttgctggatgtgaatgattccatgagtcgatgtgctgcgtctgcagcacctactacttctgttacrcaaaagttggcgaggcacagggatatacttcatgagtttagccaggaattcagacgaatcaaaggaaacataagcgcgatgacagagcatgctgagctcctaagttctgtaagagatgatatcagtgagtacaaggcatctggaagcccaagaatgcagatactaagggagcgagctgctatccatggaagcatagcacatatggatgatgtgataactcaggctcaaacaactagagcagccttggggactcagagggccatgtttggtgacgttcaagggaaagttaaacaactgagtgacaagttccctatcgttcgtggcctaattggctctattagaaggaagaaatcaagggatactctcatcctatcagctgtcatagcggcttgtacgttgtttcttattatatattggctttcaagtgaggaggattatgttatcat

SEQ ID NO: 275 - DNA, 1019 bp, Thellungiella halophila
gacagatcgttcgctttggctatctgagaacgggaaggctccggcattggctcacggcggagctggagagttaccggtgaacggagacgcttactgatctgaattggtgaagattagaaatgacagaatcgagtctggatctgcaggaatcaggttgggaggaacttcggagggaagctcgtaaaatagaaggcgatctagatgttaagctctcttcttacgctaagcttggcgccaggttcacccaaggagggtatgttgacgctgggtctccaaccgttggatctggaagatcatggaagtccatggagatggaaattcaatcgttgcttgagaagttgttggacattaatgattccatgagtagatgtgctgcatctgccgcacccacaacatcggttacgcaaaagcttgcaaggcacagggatatacttcatgaatatacccaggactttcgaagaataaaaggaaaataaactcgatgagagaacatgctgagcttttgagttctgtcagggatgacataagtgaatacaaggcttctggtagtatgtcaccaggtgtgcaagtcttaagggagagagcttcgatccatggaagtatatcccatattgatgaagtcattggtcaagctcaagcgacaagagcagttcttggctctcagcgatctctgttttcagatgttcaagggaaagtaaaaaatctcggagacaaattcccagtgattcgtggcttacttggctcaattagaaggagacgttctcgggacacacttatcctctccgctgtcatcgctgcttgtacgctgtttttaatcatctactggctctctaaataaacagtttgttcatacaccaaaactataaaaaaacgagcttccctcagcatccttagatcgatttttccaagtttttttcttcttgcttttgtagtttgccattttgttgggttatgtgtttgtaggatataaatataatggtacaccatgaatcttaaaacaaagcttaaaaaaaaatttc

SEQ ID NO: 276 - DNA, 895 bp, Nicotiana tabacum
ggccattacggccgggggagaaaaagtgaatcgtggcttctgcagcaaaatccaaaaccataaacccctcaactgtaataactgtcagatcacaatccccaattgatagaaaatttggtagaaagattgatcgggtcggattggaatcagatccgaatgtcaaaggatccgagtatggagatactgctgcaagaatcagggtgggaagaattgcggaaagacgctcgcaagatcgaaggggatcttgatgttaagctttcttcttatgctaagcttggtgcaaggctcacccaaggagggtatgtagaagctggttcaccaactctaggatccagcaggtcctggaagtctatggaaatggagattcagtcattacttgagaagttactggttgtaaatgattctatgagcagatgtgcggcttctgctgcacctaccacttctgttacacagaagctggcaaggcatagggacatacttcatgaatttacccaggagtttaggcgtattaagggaaatattagctcaatgagggaacatgctgaacttcttagttctgtaagagatgatatcagtgagtataaggcatcagggagttcccccaagatgcagatactgcgggagagagctgctatacatggaagcatatctcatattgatgacgtgattaaccaagctcaaacaaccagggctgccttgggttctcaaagagctttatttggtgatgttcaaggaaaagtgaaacaattgggtgacaagtttcctatcattcgtgggctaattggttcaatcagaaggaagaaatcaagggatacactcattctatctgcagtcattgttgcttgcactttgtttcttattatctattggctttctaagtaatagatatatttgt

SEQ ID NO: 277 - DNA, 1240 bp, Solanum lycopersicum
gasgytcaactgtaataactgtcagatcacaaactcaattttcccaatccgcaggagccaaggattttccttgcaagattggtcgggtcggatccggatcagatccgtatgtctaaggatctgagtatggagatactgcaagaatctgggtgggaagaactacgcaaagaggctcgcaagatcgaaggtgatcttgatgttaagctctcttcttatgcaaagcttggtgctagggtcacacaaggaggttatgtagaagctggttccccaactttaggatccagcaggtcgtggaagtccacggaaatggagattcaatcattacttgagaagctactggatgtaaatgattctatgagtagatgtgcggcatctgcagcatctaccacttctgttactcagaaactcgcaaggcacagggacatacttcatgaatttacccaggaatttaggcgtattaagggaaatataagctcaatgagggaacatgctgaacttcttagttctgtgagagatgatatcagtgagtataaggcatcaggaagtatgtcgcccaaaatgcatatattgagggagagagctgctatacatggaagcatatctcatattgatgatgtgattaaccaagctcaaacaactagggctgccttgggttcacaaagagctttatttggtgatgttcaaggaaaagtgaaacaactgggcgacaagtttcctgtcatccgtgggctaattggctcaataagaaggaagaaatcaagggatacactcattctatcagcagtcattgcagcttgcactttgtttcttataatctattggctctcgaagtaataggtatatctgttgatacaagaaaattcagaagatcatgattttgaaggaattttgcgcttctactcactgccatttccccgataagtgaaaatcttgagttcattactatatagcttttctgtttacttctgacttccttttaagaaatattactcagtgttccgtggaatattccaccggagagaacaaatatgagttatagctttacatagcttgctgcctctgtaccaaaagacattaagaaacatccaccaagtgagtaggatagaagattagaaggcttgatgctctaccaagattatgatacaaatcctgcttacctttgtagcaaatcattatattagctgaagcaagaataataccaatccagatactgggstgttgtatagaactattcgtctta

SEQ ID NO: 278 - DNA, 1085 bp, Triphysaria pusilla
gaaataccgccattagggacggagggatcagtgtagatcagaatgtccggggatcctagtatggatgcgttgcaggaatcgggttgggaggagctacggaaagaggctcggaaaatcgaaggcgatctcgattttaagctctcctcttatgctaaactcggtgctcgtttcaaccacggaggtaatgtagatgccggctcaccaactcttggatccagtaggtcgtggaaatccattgaaatggagattcagtcattgctcgagaagttactcgatataaatgattcgatgagtcgatgtgctgcatcagctgcgtctactacttcagttagtcagaaacttgcaagacacagggacatattgcatgagtttacgcaggaattcaagcgtacccagggaaatattaactcaatgtgggaacatgcagaacttattagttctgtacgtgatgatatcactgattacaaggcttctgggagtgtgaatccaagtacgcagttgcttagggagagggctgccatacatggaagcatatctcatattgatgatgtgattagccaagcacaagcaactagatcagtcttgggttcacaaagagccctgtttggagacgttcaaggaaaagtcaagcaactcggtgaaaaatttccagtcattcgcggtctaattggttcgatcaaaagaaaacgctcgaaagacacacttatcctttctgccgttattgctgcttgtacgctttttctcataatctattggctctccaagtgaacagaaactcaatctgttttgggatagaggcttttctaatgagttttcctagatatagtttttcggaagaggatttagttctttccggtgagctgcctgtttcagattgttgtattgaacactcattcgattgttcacatgtacataaagaatatgaactgtggttattttagttttaatacgaacataatggattgatcattggtggatgataatttcaycagattttgtgtttgtaatgtttggactgtcacctcaagtgctattatgagtcaaaatgattttggccccatgtatattatcttccatacatttca

SEQ ID NO: 279 - DNA, 1725 bp, Malus domestica
cacgaggtctcactctctcactctctctctctcactctctcactctctccctctccctctctctctcctcccgctttctctctctaaagactcagtctttccatggcaatttccacagcagcagctgcagctgcaacctcagcttcctcaaagctcgcatacccatatgcctccacagcctccccgtcccccacaacctcttctttctccattagaccttcttccaagctcacccacctctcctcctccttcctcaacccctccaccatcctccacctcacacccgcctccaacacccgccaccaccgccgcaacttcaccgtcaaagccgccagaggtaagttcgagcgcaagaagccccatgtcaacatcggcacaatcggccacgtcgaccacggcaagaccaccctcaccgcagccctcaccatggccttggcctccatcggcaatagcgtctccaagaaatacgacgaaatcgatgccgccccggaagagcgcgcccgtggaatcaccatcaacaccgccaccgtcgagtacgagaccgagaaccgccactacgcccacgtcgactgccccggccacgccgattacgtcaagaacatgattaccggcgccgcccagatggacggcgccattctcgtcgtctctggmgccgacggcccaatgccgcagaccaaagagcacatcttgctggcgaagcaggtgggtgtgccgaacatggtggttttcctgaacaagcaggaccaggtggacgacgaggagctcttgcagctcgtcgagttggaggtgagagagttgctttcttcctatgaatttcctggtgatgatgtgcctattatttctggatctgcactgcttgcactagaggctctaatggcgaatcccaccatttcgcgaggcgaaaatcaatgggttgataagatttatgaacttatggactctgttgatgattacattccgattcctcagaggcagactgagctgccatttttgatggcgatcgaagatgtgttttcgatcactggccgtggcactgtcgccactggccgtgtcgagagggggaaggttaaggtcggagacaccgtcgacattgttggcttgaaggacaccaggaacacaactgtcaccggtgtcgaaatgtttcagaaaattcttgatgatgccatggctggtgacaatgtggggttgttgcttaggggtatccagaagattgatatccagagagggatggtgttggccaaacccgggactattaccccgcataccaaattcgaggcgattgtgtatgtgttgaagaaggaagaggggggaaggcattcaccgttcttttcgggttacaggccgcagttttacatgaggactactgatgtcaccgggaaggtgacttcgattatgaacgataaggatgaggagtcgaagatggtgatgcctggcgatcgcgttaagattgtggtcgagctgattgttccggtggcgtgcgagcaggggatgaggtttgccatcagagaaggagggaagactgttggagctggtgttattcaatccattattgagtgatagaaaatacaaattatgtggtggtctcaacttgtttttgcaatttggtgcccaacttgaactctctcagcttcaatttttatctggtttttgacattttgaagcaatttccaccatgaaatgttatatatcttgtaggtttcatcatcttgatttgctctgcttttt

SEQ ID NO: 280 - DNA, 1756 bp, Malus domestica
aaacaagataacactatccctctctcgctctccttcctccttcacattatccccaaaaccccccaaatccgagcccctatcttcttcctccttcctccctttctctctcctcccactttctctctctaaagactctgtctttccatggcaatctccacactagcagctacagctgcaacctcagcttcctcaaagctcacttatccatatgcctccccagcctccccttcccccacaaccccttctttctccattagaccttcttccaagctaacccacctctcctcctccttcctaaacccctccaccatcctccacctcacaccctccaccgccaccccccaccaccaccaccgacgccgcaacttcacagtcaaagccgccagaggcaagttcgagcgcaaaaagccccatgtcaacatcggcacaatcggccacgtcgatcacggcaaaaccaccctcaccgccgcgctcaccatggccttggcctccatcggcaacagcgtctccaagaagtacgacgaaatcgacgccgccccggaagagcgcgcccgtggaatcaccatcaacaccgccaccgtcgagtacgagaccgagaaccgccactacgcccacgtcgactgccccggccacgccgattacgtcaagaacatgattaccggcgccgcccagatggacggtgccattctcgtcgtctccggcgccgacggcccaatgccgcagaccaaagaacacatcttgctggcgaagcaggtgggtgtgcccaacatggtggtgttcttgaacaagcaggaccaggtggacgacgaggagctcctgcagctcgtcgaattggaggtgagagagctgctttcttcctatgaatttcctggtgatgatgtgcctattatttctggatctgcattgcttgcactagaagctctaatggcgaatcccaccatttcgcgaggcgaaaatcaatgggttgataagatttatgaacttatggacgctgttgatgattacattccgattcctcagcggcagactgagctgccgtttctgatggcaatcgaagacgtgttttcgatcactggccgtggcactgtcgccactggccgtgtcgagagggggaaggttaaggtcggagacaccgtcgacattgttggcttgaaggacaccaggaacacaactgtcaccggtgtcgaaatgtttcagaaaattcttgatgatgccatggctggtgacaatgtggggttgttgcttaggggtattcagaagattgacatccagagagggatggttttggccaaacccgggactattaccccgcataccaaattcgaggccattgtgtatgtgttgaagaaggaagagggggggaggcattcgccgttcttttcgggttacaggcctcagttttacatgaggaccactgatgtcaccgggaaggtgacttcgattatgaacgacaaggatgaggagtcgaagatggtgatgcctggcgatcgcgttaagattgttgtcgagctgattgttccggtggcgtgtgagcaggggatgaggtttgctatcagagaaggagggaagactgttggagctggcgttattcaatccattatcgagtgatagaaaatagaaattatgtggtggtctgaacttatttttgcaatttggtgtcaaacttgaactctcttagcttcaattttatctagcttttgacatttccaagcaatttccacaacgaaatgttatatattttgtaggtttcatcatc

SEQ ID NO: 281 - DNA, 1828 bp, Aquilegia formosa
taagagcttctcttcattctcaacccaacaatcctctcttctctctttcaatctttctctctcctttcttcacaatcacacaccagtagttactagttagagaagaaagaaacaagtattagttttcggttacatcatcttctttaataatggcgattgcatcttcatcctcaatagtttcttcttcaaaacttcttttcacacctaactcttcatcttcttcatctactcactctatcactccatttaatcgaatttctaaatcaaccccacttctttcatcttcatttgccaacccatcaagtattttttggttatctaactcaaccccaacaactgaaactcgtcgttctcgttctcttactgtacgtgctgctagaggaaaatttgaaaggaagaaaccccatgtcaacattggtacaattggtcatgttgaccatggcaaaactactcttactgctgctctaactatggctttagcttctatgggtactactgcaccgaaaaaatacgatgaaattgatgctgcacctgaagaaagagctagaggaattacaattaacactgctactgtcgaatacgagacagaaaatcgacattatgctcatgttgattgtcctggacatgctgattatgttaagaatatgattactggtgctgcgcaaatggatggcgcaattcttgttgtttctggtgctgatggtcctatgccacaaacaaaagaacacattttgttggctaaacaagttggtgtacctaatatggttgttttcttgaataaacaagatcaagttgatgatgctgagttacttgaattggttgaattagaggttcgtgaacttttatcttcttatgaatttcctggtgatgatgttcctattgtttctggttctgcattattagctttagaagcacttatagctaatcctaaaattaagagaggagaaaatgaatgggtagataagatttatcaacttatggattctgttgatgaatatattcctatcccgcaacgtcagactgaattaccctttcttctagctgtggaagatgtgttttcaattactggtcgtgggactgttgctaccgggcgtgttgagagaggtactgttagggttggagagacgatagatcttgttggtcttagggataccagaagcactactgttactggtgtggaaatgtttcagaaaattttagatgaagctcttgctggagacaatgttggtcttcttcttcgtggtattcagaaggcagatattcagagaggaatggtactggcaaagccaggttctattactccacacacaaagtttgaggctatcgtttatgtccttaagaaggaagagggtggtaggcattcgccgttctttgctggttacagacctcaattttatatgaggacgactgatgttactggaaaggtttactccattatgaatgacaaggacgaggagtcgaagatggttatgcctggggatcgtgttaagatggttgtcgaacttatcatgcctgtggcttgtgagcagggtatgaggtttgctatcagagaaggaggaaagactgttggagcaggagttattcaggccatcatcgagtaaatatgtcaattgcttttcgagccaacaataagacccttggcatggtttgcaatgatccttactctttctatggtttcgggtttgatatgattaactgtatgcagtgagattcactagttttacatccgttcctgaaccaatgtcatatattttccagttttgttcttcttatctttctgttatgatgtttagtttagctagatgaacgaacccttgattattttaca

SEQ ID NO: 282 - DNA, 1718 bp, Phaseolus coccineus
agcatcaacaccaccactcccaatggcaatttcttcggcggcggcaggagcaacctcaaagctcgcataccctcatgtctacccctcttcttcaccctcctccaattccctctttctcaaaacccacgcaccctccaccacccacctttcctcctccttcatccacccctccacggtcctccacctcgcccccacccccgccgcccttcgccgccgctccttcaccgttcgcgctgcccgcggcaagttcgagcgcaagaagccccacgtcaacatcggcaccatcggtcacgtcgaccacggcaagaccaccctcaccgctgccctcaccatggccctcgcctccctcggcaacagcgcccccaagaaatacgacgaaatcgatgctgcccccgaggagcgtgcccgaggcatcaccatcaacactgccaccgtcgagtacgagaccgagaaccgtcactacgctcacgtcgactgccccggccacgctgactacgtcaagaacatgatcaccggcgccgcccagatggacggagccatcctcgtcgtgtccggcgccgacggcccaatgccgcagaccaaagaacacatccttttggccaaacaagtcggtgtccccaacattgtggtcttcctcaacaagcaggaccaggttgatgacgaggagcttctgcagttggtagaattggaggttcgcgagcttctttcttcgtacgagttccctggtgacgatgttcccattgtttctggttctgcattgttggctttggaagctttgatggccaacccttccatcaagcgcggcgaaaaccaatgggttgataagatttacgagctcatggaagctgtggataactacattcccatccctcagcgccaaactgaacttccctttttgttggccattgaggatgtgtttactatcactggaygtggaaccgtggctactggccgtgttgagcgaggtaccattaaggttggagagacggttgacattgttggtgtgagggaaactaggaacaccactgtgactggggtggaaatgtttcagaagattctggacgaggctttggctggggacaatgtggggttgttgcttaggggtattcagaagatggatattcagagagggatggttttgtctaagcctggaagcattacccctcacaccaagttttctgcaattgtgtatgtcttgaagaaggaagagggtggcaggcactctcccttcttcgctggttacaggcctcagttctacatgaggaccactgatgttactggcaaagtaacttccattatgaatgacaaggatgaggagtccaagatggtgatgcccggtgaccgtgttaagatgattgttgaacttattgttcctgtggcctgtgaacaaggaatgaggtttgctatcagagaaggaggcaaaactgttggagctggtgttatccaatctatcattgagtaaattgtgagattggcatcccaaccacttgactcttacatttgtaggccaagaaagtatctgtcgtcgaccatgggcttgtgcaattgagttttgtcattttacacaactgctgttatatccattttgttatattttgtaggtatctagatgatgtttagtcaagttggacaatgaattaccaatggcttgtttgacttccatcttttttttattgttataattcatattttaagtgcttgagcaagattccacaaaa

SEQ ID NO: 283 - DNA, 1789 bp, Phaseolus coccineus
catcttctctctcttcactctctgcaattcccatttccaaaaccatggctctttcttcagcaacagcttcctccaaactcatactcttcccacatgcatcttcttcttctccttcttcttcttcttctccttcatcctcgtctctaaattccacacccttccgttccaccaccaccactacccataaattaacccctctctcctcctccttcctccaccccaccaccatcctccgccgcaccccctctaccacaacccaccgccgccaattcaccgtccgcgccgcgcgcggcaagttcgagcgcaagaagccccacgtgaacattggcaccatcgggcacgtggaccacggcaagactaccctcaccgccgccctcaccatggctctcgccgcccttggcaacagcgccccgaagaaatacgacgagatcgacgcggccccggaggagcgcgcccgcggcatcaccatcaacaccgccaccgtcgaatacgaaaccgaaaaccgccactacgcccacgtggactgtcccggccacgccgactacgtcaagaacatgatmaccggcgctgcccagatggacggcgccatcctggtggtctccggcgccgacggccccatgccccaaacgaaagaacacatcttgttagcaaaacaagtgggcgtgccgaacgtggtggtcttcctgaacaaacaggaccaagtcgacgatgaagaactcctccaattggtcgacctcgaagtccgcgagcttctctcctcctacgagttccccggcgacgacatccccatcatctcgggttccgcgctcttagccctggaagctctcatggagaaccctggaatcaaacgcggcgacaacgaatgggtcgataaaatctacaaactcatggacgaagtggacagctacattcccattccgcagcgccaaaccgatctccctttycttctcgccgtggaagacgttttcacaataacagggcgtggcacagtcgcgacggggcgagtggagcgtgggacgatcaaagttggtgaaaccgttgaccttgtaggcttgagggaaacgaggaacacgaccgtcaccggcgtggagatgttccagaagattctggacgaggcgttggcgggggacaacgtggggctgttgctgagagggattcagaagatggatattcagagaggaatggttctggcgaagcctgggagcattacgccgcacaccaagttcgaggccattgtttatgttttgaagaaggaggaaggtgggaggcactcgcctttctttccagggtacaggcctcagttttacatgagaaccaccgacgtgacgggaaaggtgacctccatcatgaacgacaaggacgaggagtccaagatggtgatgcctggtgaccgtgttaagattatcgtcgagctcattgtgcctgtcgcctgcgaacagggaatgaggttcgccattagagaaggagggaagaccgttggtgctggtgttatccaatccattatcgagtgaattctcaaactcctcccctccatttttcatctcttcttcctcttctttctatactcctttcctttcccttcttcttatactttctacctttaggatggatattcttcttccatcatcatatttttctatcccaaatcaattctcttcgctgttattactgttttacttcactatcttgaagtgtgcaacagataaggttcttaagctgttattacatttgctttcttgcatctcactgtcaaatcctctcttccactgaattcgtgttaaatttcatc

SEQ ID NO: 284 - DNA, 1458 bp, Brassica napus
ctcccccgccgccatttccacctccaccaaactcaaagccctaaacctctcctcctccttcctccctccacaatcatttaccactccatcctccactcttcccctaatccactccgccgctccttcaccgtacgcgccgcacgtggcaaattcgagagaaaaaaacctcacgtcaacatcggaacaatcggacacgtcgaccacggcaaaaccaccctaaccgccgctctcaccatggccctcgcctccatgggaaacagcgtcgccaaaaagtacgacgagatcgacgccgcgcccgaggaaagagcccgcggaatcaccatcaacaccgccaccgtcgagtacgagaccgagaaccgccactacgcccacgtggactgccccggccacgccgattacgtcaagaacatgatcaccggagccgcgcagatggacggagccatcctcgtcgtctccggcgccgacggacctatgccgcagaccaaagagcacatcctcctcgctaagcaggtcggcgtcccggacatggtcgtcttcctcaacaaagaggatcaggtcgacgacgcggagctgcttgagcttgtggagcttgaggtccgtgagcttctctcctcttacgagttcaacggcgacgatatcccgattatctccggatccgcgttgttagctgtggagacgcttacggagaatcctaacgtgaagcgtggtgataacaagtgggtggataagatctacgagctcatggacgccgttgatagctacatccctatccctcagagacagactgagttgcctttcttgttagctgttgaagatgtgttttccatcaccggacgtgggactgtagccaccgggagggttgagagaggtacggtgaaggttggagagactgttgatttagttggtttgagagagactaggaactatactgttactggtgttgagatgtttcagaagattcttgacgaggccttagctggtgacaatgtggggttgttgcttaggggtattcaaaaggctgatattcagagggggatggtgttggctaagcctgggagtattactccgcatactaagtttgaggcgattgtgtatgtgttgaagaaggaagaaggtgggaggcattctccgtttttcgcggggtataggcctcagttttacatgaggacgactgatgtcacggggaaagtgaccaagattatgaatgataaagatgaagagtcgaagatggttatgcctggggatagggtgaagattgttgtggagcttattgtgcctgtggcttgtgagcaggggatgaggtttgctattagagaaggagggaagactgttggtgctggtgttattcagtctatcatcgaatgattgttgtagcatatctctatctacttgtttttgtttttgtttcacagaactctgttgagtttttacattcaaatcaatgtcatataattcttg

SEQ ID NO: 285 - DNA, 1617 bp, Brassica napus
ccacgcgtccgawataacactccacacacaaacgtcttcactctcctcctcctcctctgctcttcccatggcgttttcttctcccgccgctacttcttcctccactagactcctttattccccctacgctgcttctccttcctcttccccttctccaaccatttccctaactctctcctcctccttcctcccttcactcacttccctctccgtcgccacctcttcccctcaccccctccgccgcgccgcgttcaccgtacgcgccgccagaggaaagttcgagaggaagaagcctcacgtcaacatcggcacaatcggccacgtcgaccatgggaaaaccactttaaccgccgctcttaccatggccttagcttccatgggaaacagcgtcgccaagaagtacgacgagatcgacgcggcgccggaggagagagctcgtggaatcaccatcaacaccgccaccgtcgagtacgagacagagaatcgtcactacgctcacgtcgactgtcctggccatgcagattacgtcaagaacatgatcaccggagctgctcagatggacggagctatcctcgtcgtctccggcgccgacggtcctatgcctcagactaaagagcatattcttttggccaagcaagtcggcgttcccgacatggtcgtcttcttgaacaaagaggatcaggttgatgacgctgagcttttggagctcgttgagcttgaggttcgtgagcttctctcgtcttatgagtttaacggtgatgatattccgattatctccggctccgctttgttagctgtcgagactctcactgcgaatcccaacgtgaagagaggtgagaacaaatgggtggataagatttacgagttgatggattccgttgatagttacatccctattccgacaagacagacggacttgccgttcttgttagctgtcgaagatgtgttttcgatcaccggtcgtggtacggtcgctacgggtcgtgtcgaaagaggtacggttaaagttggagagactgttgatttggtcgggttaagagagactaggaactacactgttacgggagttgagatgttccagaagattcttgacgaagcaatggctggagacaatgtaggattgttgcttagaggtatacaaaaggctgatattcagagaggtatggttctagctaagcccggatcgattactcctcatactaagtttgaagccattgtgtatgtgttgaagaaggaagaaggaggaagacattctccgtttttcgcgggttatagaccgcagttttacatgaggacgacggatgttactggtaaagtgactaagattatgaatgataaggatgaggagtccaagatggttatgcctggtgatagggttaagattgttgtggagcttatcgtgcctgttgcttgtgaacaagggatgagatttgctattagagaaggtgggaagactgttggtgctggagtgattcagactattctcgaataaaggaagtagcgggtaaagcatttcgccatagcaagcttgttcttgtttcttttggtgttatatttttgtgggggttcctaagattcmgaaactcttawaatysgttgcagtagtctcgtactatc

SEQ ID NO: 286 - DNA, 1951 bp, Citrus sinensis
ggcaggagtggatagaactcatgtgaggccctcttttgtcttgccagcagtaggagattagatttagtagataacataccaaatcctttcttcctctccttcattttttcttctttaccccgaaaccctcaatctccttcagtccttctttctctctctctctgagacaaaagcacaaacgctttctctgcactcgactaaaatagagaatatggcaatttcagcctcagcagcagccaccgtagcttccacttctccaaaactcacgcacccttacgcctccgcctctccttcaaactctttaccctccaccactgctctccgtactaaattaaccccatccaatctctcctcctcctttctccccccattcgccaccaccaccaccgctgttactgtcacaacaactcgccgccgctccctcatcgtacgcgccgctcgtggcaaattcgaacgcaagaagccccacgtcaacatcggaaccatcggccacgtcgaccacggcaagaccactctcaccgccgccttaaccatggccttagcctctctgggcaacagcgcccctaaaaagtacgacgaaatcgatgccgcccccgaagaaagagcccgtggtatcaccatcaacaccgccaccgtcgagtacgagaccgagaaccgacactacgcccatgtggactgccctggccacgccgattatgttaagaatatgattactggcgctgcccaaatggacggtgcgattttggtggtgtccggtgctgatgggccaatgccacaaactaaagaacatattttgttggctaagcaagtgggtgtccctaacatggttgtgtttttgaataaacaggaccaggttgatgatgaagagctgttgcaacttgtggaattggaggttcgtgagttactttcttcttatgaatttcctggtgatgatgtgcctattatttctggttctgcgctcttagctttagaggctttgatggctaatcctagtattaagagaggagagaatcaatgggttgataagatttatgagcttatggattctgttgatagttacattcctatcccacaaagacaaactgatttgccctttttgttagctgttgaagatgtgttttcaattactggtcgtggtactgtggccactggccgtgttgagagaggtactattaaggttggagagactgttgatcttgtgggattgaaggaaactaggaatttcactgtaactggggttgaaatgtttcaaaagactctagacgaggcaatggctggggataatgtcgggttgttacttagaggtgtacaaaaggctgatattcagagagggatggtgttggccaagcccggaacaattactccccatactaagttccttgccattgtgtatgtgttgaagaaggaagaaggtggtaggcactcacctttctttgcgggttacaggcctcaattttacatgaggaccactgatgtgactggaagggtgtcttctattatgaacgacaaggacgaggagtccaagatggttatgcctggtgaccgtgtcaagatggttgtggagcttattatgccagtggcttgtgagcaagggatgagatttgccatcagagaaggaggaaagactgttggagctggtgttattcagtccatcattgaatgatagtactaggaactttcatgggcagtggattatcttttacttttttgagcggtgttaaacttcatattcttaagtttttatggaattagtttcaccattctaggaacttccagaacctaatgtcatataatttgcagttttgttcttattttgcattgaactcatgtcaagtctagttggaaaatgttcatgtgataattcaatatgactcacttttcctcagttgcttcagctaatgttgatttgcctgtggtaaatatttcaacataagaaagaaaaagttctggt

SEQ ID NO: 287 - DNA, 1856 bp, Trifolium pratense
gcacgaggaacaaatcctcttttctctcttcactcccaaattcccactcaatttctttcttcttcttcttcttctttaaccatggcaatttcaatttcttcatcatctacttcctccaaacttaaactaaccccctctcactcaccaaactcccacactttcatcgctgcttccgcttccacccgttccaccacaaacccccccaaactaaccctaactcgtctcacttcatcattcctcaacccatccacaatcctccacttaactcccacttcccattactcaaaccaccaacgtcgtttcaccgttcgtgccgcacgtggcaaattcgagcgcaaaaaacctcatctgaacatcggtacaattggtcacgtcgaccatggtaaaaccactttaactgctgctcttactatggctcttgcttctctaggtaacagcgcccctaaaaaatacgatgaaattgacgctgctcctgaagagcgtgctcgtggtattactattaatactgctactgttgaatatgaaaccgaaactcgtcactatgctcatgttgattgccctggtcacgctgattatgttaagaatatgatcaccggtgctgctcaaatggacggcgctatcctcgttgtctccggtgctgatggtcccatgcctcaaaccaaagaacacatccttctcgccaaacaggtcggtgttccgagtgtggttgtgtttttgaacaagcaggaccaagtggatgatgaggagcttcttgaacttgtggaccttgaagttcgggagcttctctcatcttatgagtttcctggtgatgacattccgattgtttctggttccgcgctcttggctttagaagcattgatggcaaatcctacacttaaacgtggcgataacaagtgggtggataagatttaccagctcatggacgaagttgacaaatacataccaattcctcaacgtcaaacggatctcccctttttgcttgccgttgaggatgtgttttcaatcaccggtcgtggaacagttgccaccgggagaatcgaaagagggaccgttaaagttggtgatgtagttgaccttgttggtttgaggaacacaaggagcacaacagtgacaggagtggaaatgttccaaaagattttggatgatgctatggccggcgacaacgtggggttgttgctgagaggtgttcagaaggatgatattgagagaggaatggttttggctaagcctggaactattactccccactctaagtttagtgctattgtgtatgttttaaagaaggaagaaggtggaagacactcacctttctttgctggttataggcctcagttttatatgagaactaccgatgttaccggaaaagttacgtctattatgaatgataaagatgaggagtcaaagatggtgatgcctggtgatcgtgttaagatggtggttgagcttattgttcccgtggctattgaacaaggaatgaggtttgctattagagaaggagggaagactgttggagctggtgttatcggagctatcattgtttgaatgaagatttctatccggctgctgtagcattgctctttaaatggggtttctttatttatttatttttaatgcaatcaattaattgacttttgccttctcatacaacttgtctgcggtaatttatagggttaaatttaacttcgggatgatctttagtcaaattggattggatactatttttccatcagaatgttttgttgtttgttgttgttaattgcttatacctgttttgtctcttactgttgggtttcttaaattgcatcaatgatgagatttatgttgagggatcaactgttacagttttcctctttatt

SEQ ID NO: 288 - DNA, 1876 bp, Gossypium hirsutum
ttcacaaaccctcatcctcaaagccacagaggaataagataacacaaacccaaatctcttttaccttctcttcttcattttccaaagccaaaggccaaaaccctcctttcctctcctctcctctcctctacaaggaaatggcaatttcatcaacagcagcagccactgccgcttcttctaagcttagatacccacacgcctcccctttcccaactcactcctcaaccaccacctctgcctttttctcctcaattccctctaaactaacccctacccacctctcctcttccttcctccctcctttcctcactaccgtcgccaccacttccgtattccctcgccgtcgcggttctttcaccgtcaaagctgcccgtggcaaattcgaacgcaaaaagccccacgtcaacatcggcaccatcggccatgtcgaccacggcaaaaccaccttaactgccgctctaactatggccttagcctccatgggtaacagtgccccaaaaaagtacgacgaaattgatgccgcccctgaagagcgtgcccgtggtatcaccattaacaccgccaccgttgaatacgaaaccgagaatcgccattacgcccacgtcgactgcccagggcacgctgattatgtcaaaaacatgattaccggagctgcccaaatggacggtgctatcttggttgtttccggagccgacggacccatgccccagactaaagagcatatcttgttggctaaacaggtcggtgtccctaacgtggttgtgttyttgaacaaacaagaccaggtagatgatgaagagcttttgcaattagtcgaattggaggtgcgtgaattgctttctagttacgaatttcccggtgatgatgtccctattatttctggctccgcacttttagctttagaagctttgatggctaagcccagtattcctaggggtgaaaaccaatgggtggataagatttatgaacttatggatgctgttgatagttacattcctgttcctcaaagacaaacagatttgcctttcttgttagctgttgaggatgtgttttccatcacgggtcgtggtactgttgccactggtcgtatcgagagaggtactgttaaggttggagagactgttgacattgttggattgaaggatacaaggaacgtcacagttactggtgtggaaatgtttcaaaagacattagatgacgccatggctggtgataatgttgggttgttacttagaggtgttcaaaaggccgatattcagagagggatggttttggctaaaccagggacaatcactccccataccaagttcagcgccattgtctatgtgttgaagaaggaagagggtggcagacattctcccttcttcgcaggttataggcctcagttctacatgaggaccactgatgtcactggaagggtggcttccattatgaatgataaggatgaggagtctaagatggttatgcctggtgaccgtgtaaagatggtagttgagcttatcatgcctgtggcttgtgagcaagggatgcggtttgctatcagagaaggagggaagacggttggagccggggttattcagtctattattgagtgatcttaggatactttggcgttgcaggatatgttatttgctgttgcagtgatgtcaaagaaccttcatatgcgaaatgtcaaggtcatgcaattagtttcgtcaccatttatagatcctctttgattccaatgtcatattttggagttttgtatttcttttgcttcagactcatgtctaatctagttggattggtaatattcatgtcacaattcgatatgattttatttctctgttgcttttgctgttatwgctaattctkaatcataccttttgcttgctct

SEQ ID NO: 289 - DNA, 1787 bp, Vigna unguiculata
ctcttcttcgccaaacccaaaacctcactctccaccttcaaccaccaatcccaatggcaatttcttcggcggcggcagcagcagcaacctcaaagctcgcataccctcatgtctacccctctccttcaccttcatccaattccctattcctaaaatcccacacaccctccaccacccacctttcctcctccttcatccacccctccacggtcctccacctcgctcccgtccccgccgccctacgccgccgctccttcaccgtccgcgctgcccgcggcaagttcgagcgcaagaagccccacgtcaacatcggcaccatcggtcatgtcgaccacggcaagaccaccctcactgccgccctcaccatggccctcgcttccctcggcaacagcgcccccaagaaatacgacgaaatcgatgctgcccccgaggagcgcgcccgaggcatcaccatcaacactgccaccgtcgagtacgagaccgagaaccgtcactatgcccacgtcgactgccccggccacgccgactacgtcaagaacatgatcactggcgccgcccagatggacggagccatcctcgtcgtatccggcgccgacggcccaatgccgcagaccaaagaacacatccttttggccaaacaagtcggtgtacccaacattgtggtcttcctcaacaagcaggaccaggtcgatgacgaggagcttctgcagttggtagaattggaggttcgtgagcttctttcttcgtacgaattccctggtgatgatgttcctattgtttctggttctgcattgttggctttggaagctttgatggccaacccttccatcaagcgcggcgaaaaccaatgggttgataagatttacgagcttatggaagctgtggataactacattcccatccctcagcgccaaactgagcttccctttttgttggccattgaggatgtgtttaccatcactggacgtggaaccgtggctactggccgtgttgagcggggtaccattaaggttggagaaacggttgatattgttggtgtgaaggaaactaggaacaccactgtgactggggtggaaatgtttcagaagattctggacgaggctctggctggggacaatgtggggttgttgcttaggggtattcagaagactgatattcagagagggatggttttatctaagcctggaaccattacccctcacaccaagttttctgcaattgtgtatgtcttgaagaaggaagagggtggcagacattctcccttcttcgccggttacaggcctcagttctacatgaggacaaccgatgttactggcaaagtaacttccattatgaatgacaaggatgaggagtccaagatggtgatgcccggtgaccgtgttaagatggtggttgaacttattgtccccgtggcttgtgaacaaggaatgaggtttgctatcagagaaggaggcaaaactgttggagctggtgttatccaatctatcattgagtaaattgtgtgagattggcatcccaactacttgcctcttacatttgtgggccaagaaagtatctatcatctacgatgggcttgtgcaattgagtttttttcattttacacaactgctgttatatccattttgttatattttgtaggtttctagatgttgtttagtcaagttggacaatgaattagcaatggcttgtttgacttccatcttttttttgttgtcataattcatttattaagtgcttgagcaagattccacaaatttctgcttgcgtgaaattatgagatttgtctt

SEQ ID NO: 290 - DNA, 1841 bp, Vigna unguiculata
ctcaccaacaccaccagataacactcataacaccttacactcacacaaacttcgtcttctcttttcactctcttcactctccaaaatcccaattctccaaaaccatggcactttcttctgcaactgcttcctccaaactcatactcttcccacatgcatcatcatcttcttcttcttcacccacttctctaaattctacacccttccgctccaccaccaccaccaccacccataaaccaaccactctctcttcctccttcctccagccctccaccatcctccgccgcacaccctccaccacaacccaccgccgccaattcaccgtccgtgccgcgcgcggcaagtttgagcgcaagaagccccacgtcaacataggcaccatcggccacgtcgaccacggcaagaccaccctcaccgccgccctcaccatggccctcgccgccctcggcaacagcgcccccaagaagtacgacgagatcgacgccgccccggaggagcgcgcccgcggcatcaccatcaacaccgccaccgtggaatacgaaactgaaaaccgccactacgctcacgtggactgccccggccacgcggactacgtcaagaacatgatcaccggcgccgcccagatggacggcgccatcctggtggtgtccggcgccgacggccccatgccccaaacgaaagaacacatcttgttggcaaaacaagtcggcgtgcccaacatggtggtgttcctgaacaaacaggaccaagtcgacgacgaagaactcctccagttggtggaattggaagtgcgcgagcttctctcgtcgtacgagttccccggcgacgacatccccatcgtctcgggctccgcactcttggctctggaagctctcatggagaaccctgcaatcaaacgcggcgacaacgaatgggtggataaaatctaccaactgatggacgaagtggacaactacattcccattccgcagcgccaaaccgaactccctttccttctggccgtggaagacgttttcacaatcaccgggcgtgggacggtggcaacggggcgagtggagcgtgggacgataaaagttggcgacaccgttgaccttgtgggtttgagggaaacgaggaacacgacggtgacaggcgtggagatgttccagaagattcttgacgaggcgttggcgggggacaacgtggggctgctgctcagagggattcagaagatggacattcagagagggatggttctggcaaagcctggcaccattacgccccacacgaagttcgaggccattgtttatgttctgaagaaggaggaaggtgggagacactcgccgttctttgcagggtacaggcctcagttttacatgagaaccaccgacgtgacggggaaggtgaccggcatcatgaacgacaaggacgaggagtccaagatggttatgcccggtgaccgtgttaagatggtcgtcgagctcattgttcctgtcgcctgcgaacagggaatgaggttcgccattagggaaggaggcaagaccgttggtgctggtgttatccaatccatcatcgagtgatttctctcatttttcttttccttcttcttcctcttccttttatactcctttcctttccctttttcttatactttctacctttacgatggatattgttattccatgatcatattcttctatcccaaatcaattctctttgctgttactgctctttgcttcactatcttcaatggaatgcaagctcctcacatcaggtagttaagctgttacatttggctatttacttctactctatgtttggtttcttgcatctattcaattcaatggtgatcaatttcatga

SEQ ID NO: 291 - DNA, 1644 bp, Vitis vinifera
ccctccaccaccttccttttaacccccaccaccactgccaccaccactcagcgccgttctttcactgttcgagctgccaggggaaaattcgagaggaataagccccatctcaacattgggacaattggccatgtcgaccacggcaagaccactctcactgccgctcttaccatggccttagcggccatgggcaacagcgcccccaagaagtacgacgaaatcgatgccgccccggaagagcgcgcccgtggaattactattaacactgccaccgtcgagtacgagactgagaaccgccattacgcccacgtcgattgccccggtcatgccgattatgtcaagaacatgatcaccggggctgcccagatggatggcgccattctcgtcgtctccggcgctgacgggcccatgccccagaccaaggagcacatactgttggccaagcaagtgggtgtccccaatatggttgttttcctcaataaacaagaccaagttgatgacgaggagcttctgcaacttgttgaattggaagttcgtgagcttctttcttcgtatgagttcccaggtgatgatgttcctatcatctctggctcagctcttttggctttggaagctctgatggcaaatcccagcattaagcgaggtgaaaaccaatgggtcgataaaatttatgagcttatggattctgttgacagttatataccaattccccaacgccaaaccgatctcccatttcttcttgccattgaagatgttttttcaatcacgggtcgtggaaccgtggccaccggccgtgtcgagaggggtacgattaaggttggagagacagtggacattgtgggtctgaaggacacccgaagcactactgtaactggggttgaaatgtttcagaaaattcttgatgaggcgcttgctggggacaatgttggaatcttactcaggggtgttcagaaggctgatatccagagagggatggttttagctaagcccggtaccattaccccgcatactaagtttgcagcaattgtgtatgtgctaaagaaggaagagggtggcaggcattcaccatttttcgcagggtatagacctcaattctacatgaggactactgatgtgactggcaaggtgacatccattatgaatgataaggatgaggagtctaagatggtgatgcccggtgaccgagttaagatggtggttgagctcataatgccagtggcttgcgagcaagggatgaggtttgccatcagagaagggggcaagactgttggagctggtgttattcagtccatcattgagtgatactaggaagctttggcataacagcaaatgctcttcttcactttttgagtagtgtccaaacttcatatcttaagctttatgcatttagttccacccttttatggatcttcccggatgtcatatattctgcaattttgttattcttttgctttgtgccaatgtcttagtttagttggataatattcttgtgataattcaatgtgattagctctgttgcttcagctgttgttgagccctatcagtgcctagttgttagaacttttgcttgggatggttttccaactatgctaacatttccttttccttttaagaaacttgattcctcccccccactttctttta

SEQ ID NO: 292 - DNA, 1744 bp, Vitis vinifera
attttcctatcgataatccatctccacacaaaacgcttccatggcttccatcgtcggagccccatccactccctctaaatccctattcacatcaccgtcactttcaaaccctaagcccacttcctttttccacaaaactcaaaccctagccaccaaatctaacccccctttcgcctcctctttcaccaatgcctcctccattttccgatactccgtcctttcttctccgtccaccggatcttctccatttcggcgccgctcactcactgtccgcgccgccagaggcaagttcgagcgcaagaagccgcacgtcaacattggaaccatcggccacgtggatcacggcaagaccactctcacggcggctctgaccatggcgctggcatccatggggaacagcgctcccaagaagtacgacgagattgacgcggcgccggaggaacgggcgcgtggaatcaccatcaacaccgctacggttgagtacgagacggagagtcggcattacgcccacgtggattgcccaggccacgctgactacgtcaagaacatgatcaccggcgcggctcagatggacggcgccattctcgtcgtctctggcgccgatgggccgatgccgcagaccaaagagcatattcttctcgccaagcaggttggagtgcccaatatggtggttttcctcaataagcaagaccaggttgatgatgaagagcttcttcagttggttgaattggaggttcgtgagcttctcgcttcgtatgaatttcccggcgacgatattcccattgtatccggatcagcattgctagccctagaggcattgatggcaaaccctagcattaagagaggagagaatgaatgggtcgataaaatctatgaattgatggatgctgttgatagttacattccaattccacagcgccagaccgatttgcccttcctccttgcagttgaagatgtgttttcgatcactggtcgtgggactgtggcaacaggtcgtgtagaaaggggtacaatcaaggttggggagactgttgatcttgttggattgagagagactcgggccactactgttactggagttgagatgtttcagaaaattctagatgaggcacttgctggtgacaacgtggggcttttgctgagaggtattcagaaggctgatatccagagggggatggttctggcaaagcctggaactattacgccacacactaagttctctgccattgtttatattttgaagaaggaggagggtgggaggcattcgcccttttttgcagggtataggccacaattctacatgaggactactgatgtcacaggcaaggttgcacaaatcatgaatgataaggatgaagagtcaaagatggttatgccgggagaccgtgtaaagatggttgtggagcttataatgcctgtggcatgcgaacaaggaatgagatttgctattagagaaggggggaagactgtgggtgctggtgtaatccagtccattattgaatgatcttggagttcatttaatattattgatgtttttcatgtctggcatctggtgagtgaaactacctccatgttcatttttaacgagattttaagtttagttagcattaatatgttacagaaaacctccatggattgttttcttgtgtgcttttgatttactttgatgatagcatttcaacatcttattatttgtctttcatatcattcagcgatcattaaaatattgtcttagtttttcggg

SEQ ID NO: 293 - DNA, 1652 bp, Lactuca sativa
  misc_feature (1649)..(1650): n is a, c, g, or t
ctagccacacacattcaccctatccatcttcttccccaaatcctatcttcttccctctgtaaatggcgtccatctccgccgcagccaccgctgcagcttcatttacatacgccacgccttcctcatcttcctcttcttcatgccctctttttacccttcagaaacccaccaccagaatactgctttcttcttcgtttgtctctaaagcttccacaaaccttttcctccacaacccctcttcatcctccgccaacacttckcaccgcttacgctctctcaccgtacgcgctgctcgggggaaattcgagcgaactaaaccccatgtcaacatcggaactatcggccatgtcgaccatggaaagaccacactcactgcagccctcaccatggccctagcctctacaggtggaggaattggcaaaaaatacgacgaaattgacgccgctcctgaagaacgtgctcgtggtatcaccatcaataccgccaccgtggagtacgagacggagaatcgccactacgcccacgtcgactgccctggtcacgctgattacgttaagaacatgattactggtgctgctcagatggacggagctatcctcgtcgtctccggcgccgacggccccatgcctcagactaaagaacatgtcttgttagcgaaacaagttggtgtccctaacatggttgttttcttgaacaaacaagatcaagtcgacgatgaggaattgcttgaattggtcgaattggaggtaagagaactcttatcttcttatgaattccccggtgatgatatcccaattatctccggatctgctttgttagctttagaagctctaacagaaaaccccaagattgcaaaaggccaaaacaaatgggtcgataaaatctatgaactaatggcagcagtcgacgattacatcccaatcccacaaagacaaaccgacctcccatttctgtgcgcaatcgaagatgtgttttcaatcacgggtcgtggaacagtggccacgggtcgggtcgagagaggcactgttagagtcggagagagcgttgagattgtgggtctgaaagataccagaaccaccattgttacaggagtcgaaatgtttcagaagattctagacgaagctttggcaggtgacaacgtggggcttctattgcgaggtgttcaaaagattgatatccaaagaggaatggttttggctaaaccgggttcaattacaccccacacaaagttcgaggctttggtttacgtgttgaagaaagaagaaggtggaaggcattcaccattttttgcaggttacaggcctcaattctacatgaggacgactgatgttacaggtaaagtgacttcgattatgaatgataaagatgaagaatcaaagatggttatgcctggtgatcgtgtgaagatggtggtggagcttattatgcctgttgcttgtgaacaaggaatgcggtttgcaatcagagaaggtggaaagactgttggagcaggagttatcggaaacattatcgagtgatttttatgtgttctttatggagattttatgcatttaattttgcatttttatgatacatctcttttcttgaatttatgctagcttcttagcttaattaatcgcaaatatgattcggctttcttgtaatcatcnntt

SEQ ID NO: 294 - DNA, 1779 bp, Lactuca sativa
ggtctagccacacacattcaccctatccatcttcttccccaaatcctatcttcttgccctctgtaaatggcgtccatctccgccgcagccaccgctgcagcttcatttacatacgccacgccttcctcatcttcttcttcttcgtcccctctttttacccttcagaaacccaccaccagaatactgctttcttcttcgtttgtctctaaatcttccacaaaccttttcctccacaacccttcttcatcctccgccaacgcttctcaccgccgccgctctctcaccgtacgcgctgctcgggggaaattcgagcgaactaaaccccatgtcaacatcggaactatcggccatgtcgaccatggcaagactacactcactgccgccctcaccatggccctagcctctacaggtggaggaattggcaaaaaatacgacgaaattgacgcygctcctgaagaacgtgctcgtggtatcaccatcaataccgccaccgtggaatacgagactgagaatcgccactacgcgcacgtcgactgccctggtcacgctgattatgttaagaacatgattactggtgctgctcagatggacggagctatcctcgtcgtctccggcgccgacggccccatgcctcagactaaagaacacgtcttgttagcgaaacaagttggtgtccctaacatggttgttttcttaaacaaacaagatcaagtcgacgatgaggaattgcttgaattggtcgaattggaggtaagagaactcttgtcttcctatgaattccctggtgatgatatcccaattatctccggatctgctttgttagctctagaagctctaacagaaaaccccaagattgcaaaaggccaaaacaaatgggtcgataaaatctatgaactaatggcagcagtcgacgattacatcccaatcccacaaaggcaaaccgacctcccatttctgtgcgcaatcgaagatgtgttttcaatcacaggtcgtggaacagtggccacgggtcgtgtcgagagaggcactgttagagtcggagagagcgttgagattgtggggttgaaagataccagaaccaccattgttacaggagtcgaaatgtttcagaagattctagacgaagctttagcaggtgacaatgtcggacttctgttgagaggtgttcaaaagatcgatatccaaagagggatggttttggctaaaccgggttcaatcacacctcacacaaagttcgaggctttggtttatgtgttgaagaaagaagaaggtggaaggcattcaccattttttgcaggttacaggcctcaattctacatgaggacgactgatgttacaggtaaagtgacttcgattatgaacgataaagatgaagaatcaaagatggttatgcccggtgatcgtgtgaagatggtggtggagcttattatgcctgttgcttgtgaacaaggaatgcggtttgcaatcagagaaggtggaaagactgttggagctggtgttatcggaaacattcttgagtgatcttatgtgttcttttctggagattttatgcacttaattttgcattttcatgatacatctcttttcttgaatttatgctagcttcttagcttaattaatcgcaaatatgattcggctttcttgtaatcaatcacttcatatgtcttaagtgttttctttagctattttgatctttgtttcagtcacttgaaatatagtcatatgatattgtttaaactttaatgcatatgttagagactgatacgaagattttgattg

SEQ ID NO: 295 - DNA, 1907 bp, Medicago truncatula
attttcatttcgataagaagaggttctcatttcttcttcatccacacaatacaaattcctccctcatctctacttctattcattccaaaaccaaaagagaggataacaaaacaaatcctcttctcttcactctcaattcaactatggcaatttcaatttcttcttcttcttccaccaaactcaaactctcatcaccctacccaccacacactcacaccttcaccacttcctcttccgcttccatttccaacccctccaccactcatcgtcccaaactaaccctaactcacctctcctcctccttcctcaacccctccacaatcctccacctcaccccttcctccaaacccacccccactcgctcctcccctttcaccgtccgtgccgcccgtggcaaattcgagcgcaaaaagcctcatctcaacattggaaccatcggccatgtcgaccatggcaaaaccactttaaccgctgctcttactatggctctcgcttctctaggtaacagcgcccctaaaaaatacgatgaaattgacgctgctcctgaagaacgtgctcgtggtattacaattaatactgctactgttgaatatgagactgaaactcgtcattatgctcatgttgattgtcccggtcacgctgattatgtcaagaatatgattaccggtgctgctcagatggacggcgctattcttgttgtctccggtgccgatggtcctatgcctcaaaccaaagaacacatccttctcgccaagcaggttggtgttccgagtgtggttgttttcttgaacaagcaggaccaagtggatgatgaggagcttcttgaacttgttgagcttgaagttcgggagcttctatcgtcttacgagtttcctggagatgacattccgattgtttctggttcagcgctattggcgttggaagcgttagtggcgaaccctactattaaacgtggtgataatgagtgggtggataagatttataaacttatggatgaagttgacaactatataccaatccctcaaagacaaacggaactcccctttttgctagctattgaggatgtgttttcaatcactggtcgtggaacagttgccaccggaagaattgaaagggggcttgttaaggttggtgatgtagttgaccttgttggtttgagggaaacgaggagcactacagtgacgggagtggaaatgtttcagaagattttggacgatgctatggctggtgataatgtgggtttgttgctgagaggtgttcagaagattgatattcaaagagggatggttttggctaagcctggaactattactcctcactctaagtttgaatgtattgtgtatgttttgaagaaggaagaaggtggaagacattcacctttctttgctggttataggcctcagttttacatgagaactacagatgttaccggaaaagttacatctatcatgaatgacaaggatgaggagtcgaagatggtgatgcccggtgatcgtgttaagatggtggttgaactcattgtccctgtggctattgaacaaggaatgaggtttgctattagagaaggagggaagaccgttggagctggtgttatcggagctatcattgagtgaatgaagattactatccagttgctgcatcatcactcttcaaatggagtttctttttatttatttatttttgatgcaatcaattaattgacttttgcccttcatacaacttgtctgcggtaattttatagggttaaatttaactttcggattgtctttagtcgaattggatactatttttccatcgggatgttttgtaagttgttgttgttacctgcttatacttgtttgttctcttattgttgagttccttaaattgcatcaatgatgagattgtgttgagggatcaactgttac

SEQ ID NO: 296 - DNA, 1779 bp, Populus trichocarpa
gagataacaaaacacatcctctcgtatcctctcccaatcaagaaaactccccccctctccctccgccactctctcatccgccactcataatggctgtttccgcctcagcaaccactttcacctccacaaacctcatctacccccaccacacaaccaccacatcctctacctccacccctactttctccctcaaacccacctccaaactcccctcaaaatccatcctttcctcttctttcctctcccccttcactcccacttccccaacctcccccttcaccaccacccgccaccgcaccttcactgtccgtgccgctagagggaagttcgaaagaaagaaaccccatgtcaacataggcaccataggccatgtagaccacggcaaaacaactctcactgctgctctaaccatggctctagcctctatgggtggcagtgcacccaaaaaatacgatgaaatcgatgctgcaccagaagaacgcgctagaggaatcacaattaacactgctacagttgaatatgagacagaatctcgccattatgctcatgttgattgccctggtcatgccgattatgttaagaacatgattactggtgctgctcaaatggatggagctattttggttgtgtctggcgccgatggtccaatgccacaaacaaaagaacatatcttgttggcaaaacaagttggggttccaaacatggttgtgtttttgaataaacaagatcaagttgatgatgaggagctgttgcaattggtagagttggaggtaagagaattgttgtctagttatgagtttcctggtgatgatattccaattatctctggttctgctttgttagctttagaggctttgatggaaaatcctgctattaagagaggagagaatcaatgggttgataaaatttacgaacttatggataacgttgataattatataccaattccacaaaggcaaactgatttgccatttttacttgctgtggaggatgttttttctattaccggtcgtgggacagtagctactgggagggttgagagaggtactatcaaaactggggataccgtagatattgtggggttaagggagactaggaatacaacagttactggtgtggaaatgtttcaaaagatattggatgaagcattggcaggtgataatgttgggttgttgttgagaggtgttcaaaaggctgatattcagagagggatggttttatcgaagccagggtcaattactccacatactaaatttgaggcgattgtttatgttttgaagaaggaagaaggtggcaggcattctcccttctttgctgggtataggcctcaattttatatgaggaccactgatgttacagggagggtggctacgattatgaatgataaggatgaggagtcaaagatggttatgcctggggatcgtgtgaagatgatagtggaacttattatgcccgtggcttgtgagcaaggcatgaggtttgctatcagagaaggagggaagactgttggagctggtgttattcaggccattattgagtaggtaacacaccagaggaaatatgctttattggtactttttggatggatggcggtgtcaaacttcataccctcagctttgtgcaattagtttttctccattttagcaaaactttcgaatcccatgccatatattttgcagttttgttcttttgcactttgccttaatgcttagtttagttggatatcattcttgtgaaaattcaatgtgataacgtaatcctttcttgctttggcttcta

SEQ ID NO: 297 - DNA, 1646 bp, Populus trichocarpa
acccataaagagagaacaaaacacatcctctcatacatttctctcccaatcaagaaaactctctcctctgtcactctctaatccgccactccttatggctatttccgcctcaacaactactttcacctccacaaacctcctctacccccaccactcaaccaccacatccaccacatccacccctactttctccctaacacccacctcgaaactcccctcaaaatccatcctttcgtcttcttttctccccaccctcactcccacctcctcatcctcccctctcaccaccacccgccaccgctttctcactgtccgtgcagctagagggaagttcgaaagaaagaaaccccatgtcaacattggcacaataggccatgtagaccacggcaaaacaactctcaccgctgctctaaccatggctttagcctctatgggcggcagtgcaccaaaaaaatacgatgaaatcgatgctgcacctgaagaacgcgctagaggaatcacaattaacactgctactgttgaatatgagacggaatctcgccattatgctcatgtcgattgtcctggtcatgctgattatgttaagaacatgattactggtgctgctcaaatggatggagctattcttgttgtgtctggcgctgatggtccaatgccacaaacaaaagagcatatcttgttggcaaagcaagttggggttccaaatatggttgtgtttttgaataaacaagatcaagttgatgatgaggagctgttgcagttggtagagttggaggtaagagaattgttgtctagttatgagtttcctggtgatgatattccaattatttctggttctgccttgttagctttagaggctttgatggaaaatccggctattaagagaggagagaatcaatgggttgataaaatatatgaacttatggataatgttgataattatataccaattcctcaaaggcaaactgatttgccatttttacttgccgttgaggatgttttttctattactggtcgtgggactgtagctaccgggagggttgagagagggacaattaaaactggggatacagtagatattgtggggttgagggagactaggaatgtaacagttactggtgtggaaatgtttcaaaagatattggatgaagcattggcaggtgataatgttgggttgttattgagaggtgttcaaaaggctgatattcagagagggatggttttgtcgaagccagggtcaattactccacataccaagtttgaggcgattgtttatgttttgaagaaggaagaaggtggtaggcattctcccttctttgctgggtataggcctcaattttatatgaggacaactgatgttacagggagggtggctacaattatgaatgataaggatgaggagtcgaagatggttatgcctggggatcgtgtgaagatggtggtggaacttattatgcctgtggcttgtgagcaaggtatgaggtttgctatcagagaaggagggaagactgttggagccggtgttatccagtccattattgagtaggtaataaactgtaggaaatatgctctatcggtactttttggatggcattgtcaaacttcatatctcagctttgtgcaattaaactcccgccattttagca

SEQ ID NO: 298 - DNA, 1727 bp, Solanum tuberosum
atttcttcctcactcttatccttctccgccatggcttcaatttcagcagcgtctgccaccgccacttcttctactaagctcctaaacccttctaatccccttcttccttccgctactaaaccatccaagcttatcctatcctcttcatttacccccaacttttctacccttttcctccactcacccgccgctacttctcccaccacccaccaccaacgccgcttcactgtccgtgctgcccgtggcaaattcgagaggaagaaaccccatgtcaatattggtactattggccatgttgaccatggaaagactacccttactgctgctttaaccatggctcttgcttctatgggtaattccgctcccaagaagtatgatgaaattgatgccgccccagaagagcgtgctcgtgggattactattaatacggctacggttgagtatgagactgagaaccgacactatgcccacgtggactgccccggtcatgctgattatgtcaagaatatgattactggtgctgcccagatggatggagctattcttgttgtttccggtgctgatggcccaatgccacagaccaaagaacatatcttgcttgctaaacaagtgggtgtccctaatatggtggtgtttttgaacaagcaagatcaggttgatgatgaagagcttcttgagcttgttgagttggaggtaagagagcttttgtctagttatgagttccctggtgatgatattcctattgtttctggctctgctcttttggctttagaggctttaatggcaaatcctagtattaagagaggtgaaaatgaatgggttgataagatttttacattaatggacaatgttgataattatattcctattccccaaagacaaactgagttgccttttttgatggctattgaagatgtgttttcaatcactggtagaggtacagtggcaacaggggagggtagagagagggactgttagggttggggagaccgttgatattgtaggattaagggacaccaggtctactaccgtgactggggttgaaatgtttcagaagattttggatgaagcaatggctggagataatgtgggattgttgttgagaggtattcagaagattgatattcagagaggaatggtgttggcaaaacctggaacaatcactcctcacaccaagtttgaagctcttgtgtatgtcctgaaaaaggaggagggtggcaggcattccccattcttttcggggtacaggcctcagttttacatgaggaccactgatgtgactgggaaggttacttccattaccactgataaaggagatgaatctaagatggtcatgcctggtgatcgtgtgaacttggtggttgagctcattatgcctgtggcttgtgagcaagggatgagatttgccatcagggaaggaggaaagactgttggagctggtgtcattcagaaaattcttgagtgatcaacgagcagcagcgcatttccattcaaaatggtccggtccttgtcatgcaatatttttaatcccttgtcatatatgcaacgttttggttacttcttttcttttagatcataggttagttggagaaatcttgttataagtcaatgctagtgcacctttgcgagtttgcttcaatttttgtttgtttgtttgaaaagaaggagaacattttgtatcttgtgtacgtttagtttccctcaggaaaaaatcatacttgtgattg

SEQ ID NO: 299 - DNA, 1736 bp, Solanum tuberosum
ctatcacaattcatttcactctctttctccaaatacttcaatcctcattttcaggcaaaagcttcttccatggcttcaatttcagcagcttctgcaactgctgctgctgcttctacaaagattaataccagtggtggtagtgttcttccttctaaatcctctaagcttatcctttcatcttcttttacaccaaccccatcaaccctttttctccattcaccagccactactacaccttcttcttctacccgccaccgccggtttactgtccgagctgcgcgtggtaaattcgaaaggaagaaaccccatgtcaatattggtacaattggccatgttgaccatgggaaaaccacacttacagctgctttgaccatggcgcttgcttctctgggtaactccgcccccaagaagtatgatgaaattgatgctgcccctgaagaaagagctcgtggtattacgattaatactgccacagtggagtatgaaactgaaaatcggcattacgctcatgtggattgccctggtcacgctgattatgtgaagaatatgattactggtgctgctcaaatggatggagctatacttgttgtttcaggtgctgatggtccaatgccgcagactaaggaacatattttgcttgctaagcaagtgggtgtccctaatatggttgttttcttgaacaaagaggaccaagttgatgatgaggagttgcttgagcttgttgagttggaggtaagagagttattgtcaagttatgagtttcctggtgatgatattcctattcattgtgggtctgcccttttggctttagaggctttaatggctaatcctagtattaaaaggggtgatgatcaatgggttgataagatttatacattgatggactctgttgatgaatatattcctattccacaaagacaaactgaattgcctttcttgatggctattgaagatgtgttttctattactggtagaggtacagtggctacagggagagttgagagagggactgttaagacaggggaaattgttgatatagttggattgaaggacactaggaacactacagtaacaggagttgagatgtttcagaagatattggatgaagcaatggcaggagataatgtggggttgttgttgagaggtattcagaagattgatattcaaagaggaatggtgttggcaaaacctggatcaattactccacacaccaagtttgaagctttggtgtatgtgttgaaaaaggaagaaggtggcaggcattcccctttctttgctggttataggccacagttttacatgagaacaactgatgtgactggaaaggttactgctattatgactgacaagggagaggaatctaagatggtcatgcctggtgatcgcgtaaacatggtggtcgagctcattatgccagttgcttgtgagcagggaatgaggttcgctattagggaaggaggaaagactgtcggagctggtgttattcagaaaatcttagaatgatgaacttgcagctgagcatctctttttacatatggtcggatttttccattgaagtttattaatccattgtcatatatgcgactttttggttacttttgttatgtcttagaatcttactttagttgaagtatcctgtttaatcccccaattctactgaacttttggaattttccccgtctcttgtttcacttttcatttgcttgaaagaaatgatatcatttgctctcaaaaag

SEQ ID NO: 300 - DNA, 1314 bp, Raphanus sativus
gcacgtcaacatcggcacaatcggccacgtagaccatgggaaaaccactttaaccgccgctcttaccatggccttagcttccatgggaaacagcgtcgccaagaagtacgacgagatcgacgcagcccccgaggagagagcccgtggaatcactatcaacaccgccaccgtcgagtacgaaaccgagaaccgtcactacgctcacgtagactgtcctggccatgctgattacgtgaagaacatgatcaccggagctgctcagatggacggagctatcctcgttgtctccggagcagatggtcctatgccccagactaaagagcacattctcttggccaagcaagtcggtgttcccgacatggtcgtcttcttgaacaaagaggatcaggtcgatgacgcggagcttctggagctcgttgagcttgaggttcgtgagcttctctcgtcttatgagtttaacggtgatgatattccgattatctccggctctgctttgttagctgttgagactctcactgagaatcctaacgtgaagagaggtgagaacaaatgggtggataagatttacgagttgatggattccgttgatagttacatccccattccgacacgacagacggacttgccgttcttgttagctgtcgaagatgtgttttcgatcaccggtcgtggtactgtcgctacgggtcgtgtcgaaagaggtatggttaaagttggagagactgtggatttggttggattaagagagactaggaactacactgtaacaggagttgagatgttccagaagattcttgatgaagcaatggctggagataacgtaggattgttgcttagaggtatacagaaggctgatattcagagaggtatggttttagctaagcccggttccattactcctcayactaagtttgaggccattgtgtaygtgttgaagaaggaagaaggtggaagacattctccgtttttcgccggttatagacctcagttttacatgaggacgactgatgttactggtaaagtgactaagattatgaatgataaggatgaggagtcgaagatggttatgcccggtgatagggttaagattgttgtggagcttattgtgcctgtygcttgtgaacaagggatgaggtttgctattagagaaggtgggaagactgttggtgctggagtgattcagactattctcgaataaaggaattagccatagcaagcttgttcttgcctcttttggtgtttttaccctttttgtgggattcagaaactcttgaaatttggattgcaaaattagttttctttatcatattttta

SEQ ID NO: 301 - DNA, 1866 bp, Glycine max
aaaaaaaaatactaaatttatttaaccaaaattgaaaaagctagaaacacactatttaacactctcttttttatcacaatctctcattagttaaattttattaaactagtgaagttgaaggcagaaaaggataaaacttaacaagaggagctgttttgtccaccgcattcccaaacccttgaacactatcctcttctcagtctcatacaccaaaccaaaaacctcactttccaatggcaatttcttgggcagcagcaacaacctcaaagctcgcataccctcctcatgtccacttctctccttcaccctcctccaattatctcttccttaaaacccacaaaccctccgccacacacctctcctcttccttcatccaccccaccacaatcctccacctcgccgctgccaacaccaccacccgccgccgctccttcaccgtccgcgccgcccgcggcaagttcgagcgcaagaagccccacgtcaacatcggcaccatcggccacgtcgaccacggtaagaccaccctcaccgccgccctcaccatggccctcgcctccctcggcaatagtgcccctaaaaaatacgacgagatcgacgccgcccccgaggagcgcgcccgcggcatcaccatcaacaccgccaccgtcgagtacgagaccgagaaccgccactacgcccacgtcgactgccccggccacgccgactacgtcaagaacatgatcaccggcgctgcccagatggacggcgccatcctcgtcgtctccggcgccgacggcccaatgccccaaaccaaagaacacattcttttggccaaacaagtcggcgttcccaacattgtcgtcttcctcaacaaacaggaccaggttgatgacgaggagcttcttcagttagtagaattggaggtccgggagcttctttccaagtacgagttccccggagacgatgttccgattatctccggttccgctttgctgtctttggaagctttgatggccaaccctgccatcaagcgcggcgaaaaccaatgggttgataaaatttacgagctcatggaagctgtggatgactacattcccatccctcagcgccaaactgaacttccctttttgctggccattgaggatgttttcaccatcaccggtcgtggaaccgtcgccaccggaagggttgagagaggtactattagggttggagagactgttgatattgttggtgtgaaggagactaggaacaccactgtgactggggtggaaatgtttcagaagattctggatgaggctttggctggggacaatgtgggcttgttgcttaggggtattcagaaaactgatattcagagagggatggttttggctaagcctggaaccattactcctcacaccaagttttctgcaattgtgtatgtcttgaagaaggaagagggtgggaggcactctcccttcttttccggctaccggcctcagttctacatgaggactaccgatgttactggcaaggtaactgaaattatgaatgacaaggatgaagagtccaagatggttatgccgggcgaccgtgttaagctggtggttgaacttattgtgcctgtggcttgtgaacaaggaatgaggtttgctattagagaaggaggcaaaactgttggagctggtgttatccaatccatcattgagtaaattgttgtgagattggcatcccaactacttgcctcttacattgtgggcaagagtatctatcatctacgatgggcttgtgcaattgagttttttcattttacacaactgctgctattttgttatattttgtaggtttctagatgttgtttagtcaagttggacaatgaattagcaatggcttgtttgacttcca

SEQ ID NO: 302 - DNA, 1866 bp, Glycine max
agaaaaattttcccattttatcccttcagcttgcttcatttgcattcgacttgggttaacagtgacctagagagagaaaaaaaagaaaagaaaaagatgtgatccggtgcgtccctccaaaattgaggcagaaagaggatagaagtgatatgaggtcctcttttatccatccatccacacactaccactagataacacaacactaaacaatttacattactcattacactaactcaatcctcagtctatccaaattctccagccatggcagtttcttctgcatctgcttcctccaaacttatactattcccccatgcttcatcttcttcccttatctccacacccttccgttcctccaccaacacccacaaactatcccctctctcctcctccttcctccaccccaccaccgtcctccgccgcaccccctcctccaccactaccaccacctccccgcgccgccccctcaccgtccgcgccgcccgcggcaagttcgagcgcaagaagccccacgtgaacatcggcaccatcggccacgtggaccacggcaagaccaccctgaccgccgccctcaccatggcccttgccgccctcggcaacagcgccccgaagaagtacgacgagatcgacgccgccccggaggaacgcgcccgcggcatcaccatcaacaccgccaccgtcgagtacgagaccgagaaccgccactacgcccacgtggactgccccggccacgccgactacgtcaagaacatgatcaccggcgccgcccagatggacggcgccatccttgtcgtctccggcgccgacggccccatgccccaaaccaaagaacacatcctcttagccaagcaagtcggtgtccccaacatggtcgtcttcctcaacaagcaagaccaagtcgacgacgaagagcttctccaactagtcgaactcgaagttcgcgaccttcttacctcctacgaattccccggtgacgatacccccatcgtctccggctccgcactcttagccctagaagcccttatggcgaaccctgccatcaaacgcggcgacaacgagtgggtcgacaaaatctacaaactcatggacgaagtcgacgactacattcccatcccccagcgccagaccgacctcccattcctcctcgccgtcgaagacgttttctccatcaccggccgtgggaccgtcgccaccggccgcgtagagcgtggcaccgtcaaagtaggggaaactgttgaccttgtaggattgagagagacaagaaacacaacggtcacaggtgtggaaatgttccagaagattctagacgaagccctcgccggggacaacgtggggctgttgctgagaggggttcaaaagacggacatccagagagggatggtgttggcgaagcctggcacgattacgccgcacaccaagttctcagcgattgtgtatgttttgaagaaggaagaaggtgggagacattcacctttctttgcagggtataggcctcagttttacatgaggaccaccgatgtgactgggaaggttacggctatcaccaacgatagggatgaagagtcgcagatggtgatgcccggtgaccgtgtgaagatggtggtggagctcattgtgcctgtggcttgcgaacagggaatgaggtttgctattagggaaggtggcaagaccgttggtgcaggtgttatccaatccatcattgagtgaaaattgcctcacttcatttttaattaattaatttttgccgttttatacagcttctctactttgcttgccctttttcttatactttaattgtatttgtaggatgcctattattggataataatatttttctatcccaaatgaaaatgtctttgtttgtta

SEQ ID NO: 303 - DNA, 1647 bp, Glycine max
acacaatccccttccctcttctctttctatccaaattctccaccagccatggcagtttcttcagcaacagcttcctccaaactcatactattcccccatgcatcatcatcctcttcccttaattccacacccttccgctcctccaccaccaacacccacaaactaacccctctctcctcctccttcctccaccccaccaccgtcctccgccgcaccccttcttccaccaccaccccgcgtcgcaccttcaccgtccgcgccgcccgcggcaaattcgagcgcaagaagccccacgtgaacatcggcaccatcggccacgtcgaccacggcaagaccacccttaccgccgccctgaccatggctcttgccgccctaggcaacagcgcccccaaaaaatacgacgagatcgacgccgccccggaggaacgcgcccgaggcatcaccatcaacaccgccaccgtggagtacgagaccgagaaccgccactacgcccacgtggactgccccggccacgctgactacgtgaaaaacatgatcaccggcgcagcccaaatggacggcgccatattagtcgtctccggcgccgacggccccatgccccaaaccaaagaacacatcctcttagcgaaacaagtcggtgtccccaacatggtcgtgttcttaaacaagcaagaccaagtcgacgacgaagagcttctccaactagtggagctcgaagtccgcgaccttctgagctcctacgaattccccggtgacgatacccccattgtctcgggctccgcgctcttagccctagaagcactcatggccaaccctgcaatcaaacgcggcgacaacgagtgggtcgacaagattttccaactcatggacgaggtcgacaactacattcccatcccccagcgccagaccgacctccccttcctcctcgccgtcgaagacgtcttttccatcaccggccgtggcaccgtcgccactggccgtgtagagcgtggcaccatcaaagtaggggaaactgttgaccttgtaggtttgagagaaacaaggaacacaaccgtcacaggtgtagaaatgttccagaagattctagacgaagccctggctggagacaacgtggggctgttgcttagaggggttcagaagactgacattcagaggggaatggtgttggctaaaccaggcacgattacgccgcacaccaagttctcagcgattgtttatgttttgaagaaagaagaaggtggtaggcattcacctttctttgcagggtataggcctcagttttacatgaggaccaccgatgtgactgggaaggttacgtctatcatgaatgataaggatgaggagtccacgatggtgctgcccggtgaccgtgtcaagatggtggtggagcttattgttcctgtggcttgcgaacagggaatgaggtttgctattagggaaggtgggaagaccgttggtgctggtgttatccaatccattattgagtgaaaattctgtcactttatttttaattaattaattttttccgttttatacagcttctgtactttgctttccctttttcttatactttaattgcacttttaggatggatattattggataataatatttttctgtcccaaatgaaaatgtctttgttgttct

SEQ ID NO: 304 - DNA, 1722 bp, Helianthus annuus
gaacatttatacaatccatcctccccctggatccggaagtctctcatatgtacgcattaacgtgtgaagtatatctataattcctgcacccttcccactctatccatctycccccmaaatcctatccgatgscctccatctccgcsgcagccacmgctgcwgccacmttctcctcmtcytcaccgtcaccmtcttmttsttcctcactcttcaccctaccaaaaccctccaccraattactcctytcctstrcttttctttccaawtcctccacaaatctcttcctccacacctccgcttctaactcgbcccccgccgcccaccgccgccgtgctctcaccgtacgcgccgccagaggcaaattcgagcgaacaaaaccccatgtcaacatcggaaccatcggccacgttgaccacggcaaaaccaccttaaccgccgctctcaccatggccctcgcctccaccggcggcggcgtcgccaaaaagtacgacgaaatcgacgccgcaccggaagaacgcgcgcgtggtatcaccattaacaccgccactgtcgaatacgaaacggaaaaccgccattacgcccacgttgactgccccggtcacgctgattacgtcaaaaacatgatcaccggtgctgcccaaatggacggcgctatcctcgttgtctccggcgccgacggccccatgccgcagacaaaagaacatgttttgttggcgaaacaagtaggtgttccgaatatggttgtttttttaaataaacaagatcaagttgatgatgaagagttgttagaattagttgagttagaagtaagagagttattatcatcttatgagtttcctggtgatgatattccgattatttcgggttcggctttgttagctttagaagccttgactgagaatccaaagattgcaaagggggagaacaaatgggtggataaaatctaygatttaatggctgctgttgatgattatatcccaattccacaaagacagactgaactgccgtttttgttagcgatagaagacgttttttcgattacgggtagagggacggttgccacgggtcgggttgaaagagggacggttaggattggagatagtgtcgagattgtcgggttgaaggatacacgaactaccactgttacwggkgttgagatgtttcagaagctgcttgatgaagcgatggcgggggataatgtagggcttttgttgagagggattcagaagattgatattcaaagaggtatggttttggctaagcctgcgacgattaccccgcacaccaagtttgaggcgttggtttatgtgttgaagaaggaagagggcgggaggcattcgccgttttttgcagggtatagaccgcagttctacatgagaactactgatgttacagggaaggtgacatcgattatgaacgataaagatgaggaatcgaagatggttatgcctggtgatcgcgtgaagatggtggttgagcttattatgccggttgcttgtgagcaaggtatgcggtttgctattagagaaggtgggaagactgtcggtgctggtgttatccagtcgattatcgagtgatgtatctcaaatctgtggtttttataaagtcgttttgagtttggagattttatttttcataactgtatgcacttaattttgcattgttaagatatcacacatgttgcacctattttcttgaagttatgctagtcttttagtttaa

SEQ ID NO: 305 - DNA, 1722 bp, Helianthus annuus
cacacaccacactcaccctatccagtcttctcaccaaatcctatctgcaactccaatggcttccatctccgccgcagccaccgctgccgcctccttcacctcctcctcctccccctcaccccctctcttcaccctacsaaaaccctccaccaaactccacctttcctccaccttcatcaccaacctctccctccacaaccctaatttcacctcttccacccccaccaccaccacccaccgccgccgtgccctcaccgtccgcgcagcccgcggcaaattcgaacgcaccaaaccccacgtcaacatcggcaccatcggccacgtcgaccacggcaaaaccaccctcaccgccgccttaacaatggccttagcctccaccggcggcggcgttgccaaaaagtacgacgaaatcgacgccgcacctgaagaacgcgcccgtgggattacaatcaacaccgccaccgtcgaatacgagacagaaaaccgtcactacgcccacgtagactgccccggtcacgctgattacgtcaaaaacatgatcaccggagctgcccagatggacggagctatcctcgtcgtctccggcgccgacggccccatgccgcagacaaaagagcacgtgcttttagctaaacaagtaggtgttcccaacatggttgtgtttttaaacaaacaagatcaggttgatgatgaggagttgttagaattggttgagttagaagtaagagaattgttatcatcttatgagtttccgggtgatgatattccgattatttcgggttcggctttgttagctttggaagctttgactgagaatccaaagattgcaaagggggagaacaaatgggtggataagatttatgatttaatggctgctgttgatgactacattccaattccacaaaggcagactgagttgccgttcttgttggcgattgaggatgtgttttcgattacggggcgtgggacggtggccacgggtcgggttgagagaggtacggttaggattggagatagtgtcgagattgtcgggttgaaggatacycgaacwacwactgttaccggtgttgagatgtttcagaagctgcttgatgaagcgatggcgggtgataatgtagggcttttgttgagagggatacagaagattgatattcagagaggtatggtgttggcgaagcctgcgacgattaccccgcatacgaagtttgaagctttggtttacgtgttgaagaaggaagagggtgggaggcattcgccgttttttgcagggtacagaccgcagttttacatgaggactactgatgtwacrgggaaggtgacgtcgattatgaatgataaggatgaagagtcgaagatggttatgccaggtgaccgtgtgaagatggtggttgagcttattatgccggttgcttgtgagcaaggtatgcggtttgctattagagaaggtgggaagacagttggtgctggtgttatccagtcgattatcgagtgatttcgcttaaatctgtggttttataatgagttgtttggaggttttattcatgaagctgtatgcacttggttttgcattcttatgatataacacatatttatgctagtctgttagtttaatyattgaaaatatgatcttggtttgatgttgctacattrtttaatctttattgctattttttgttatgattatgtgtgaacttgcattccacaaagaacaaaagtgaacat

SEQ ID NO: 306 - DNA, 1930 bp, Nicotiana tabacum
tccaaataggtagaaatggatagaaaaatccccccaaaatgagtatatgagcggccctattttttccttccaagggatataacactattatccccttctcctcattttctttcaaatcccaattctcactcgctctatccttaactctcttttctctcccaacttcaatctccggccatggcttcaatttcagcagccaccgccacctcctccactaagcttgtatcatccaactccaccaatcctcttcttccttcctccactaaaccctctaagcttatcctatcctcttcctttacccctaattgttccacccttttcctccactcacccgccaccccttcttctactgccacccatcgccaccgccggtttactgtccgcgctgcccgtggcaaattcgagcggaaaaaaccccatgtcaacatcggtactattggccatgttgaccacggaaagactactctcaccgctgctttaaccatggctcttgcttctatgggaaactccgcccctaagaaatacgacgaaattgatgccgccccagaagagcgtgctcgtggtattactattaacactgctactgttgagtacgagactgagaaccgtcactacgcccacgtggattgccctggtcacgctgattatgtcaagaatatgattaccggtgctgcccaaatggacggcgctattcttgtttgttcaggtgctgatggtcccatgccacagactaaggaacacattttgcttgctaagcaagtaggtgtccccaacatggttgtgttcttgaacaaacaagatcaggttgatgatgaggagctgcttcagcttgttgagttggaggtaagagagttattgtcaagttatgagtttcctggtgatgatattcctattatttctggctctgctcttttggctttagaggctttgatggctaatcctagtattaagagaggtgaaaatcaatgggttgataagatatatgagttgatggacgctgttgatagttatattcctattccagttaggcaaactgaattgcctttcttgatggctattgaagatgtgttttccattactggtagaggtactgtggcgacggggagggtagagagagggactgttaggattggagacactgttgatattgtaggtttgaaggatactaggagtactacggtgaccggggttgagatgtttcagaagattttggatgaagcaatggctggagataatgtggggttgttgttgagaggtattcaaaagattgatattcagagaggaatggtgttggcaaaacctggaacgattacccctcacaccaagttcgaagctattgtgtatgtgttgaagaaggaggagggtggtaggcattcccccttcttttcggggtacaggcctcagttttacatgagaactactgatgtgactggaaaggttacttccattacgactgacaaaggagaggaatctaagatggtcatgcccggtgatcgtgtgaacttggtggttgagctcattatgccggtcgcttgtgaacaagggatgagatttgccatcagggaaggaggaaagactgttggagctggtgtcattcagaaaattatcgagtgatcaaccagcagcggagcaatttcccttccaatggtctggcccctgtcacacagtattcttaatccattgtcatatatgcagctttttggttacttttttcttatcttttagaatcctagttcagttggagaaatcttgttataagtcaatcctagtggacatttgcgagtttgcttcagtttcgtgctttgttttttcatttgtttgcaaggaaggagaacattttgtctcttgtgcaccttactttctgccagaacaaattcatacttttgtttgaaactcgagtttaacatgyyaatgaarttwggtgmatttg

SEQ ID NO: 307 - DNA, 1945 bp, Solanum lycopersicum
tgggctattatattataggctctctttctccctaccaaaaaaagataacttcattatcctctcttccttctaccacaattcatttcactctctttctccaaaatcttcaatcctcagcaaaagcttcttccatggcttcaatttcagcagcttctgcaactgctgctgctgctgcttctacaaagattaataccagtggtactgttcttccttcaaaatcctctaagcttatcctttcatcttcttttacaccaaacccatcaacccttttcctccattcacccgccactactgcaccttcttcttcttcctcccgccaccgccggtttactgtccgagctgcgcgtggtaaattcgaaaggaagaaaccccatgtcaatattggtacaattggccatgttgaccatgggaaaaccacacttacagctgctttgacaatggcgcttgcttctctgggtaactccgccccgaagaagtatgatgaaattgatgctgcccctgaagaaagggctcgtggtattacgattaatactgccacagtggagtatgaaactgaaaatcggcattacgctcatgtggattgccctggtcacgctgattatgtgaagaatatgattactggtgctgctcaaatggatggagctatacttgttgtttcaggagctgatggtccaatgccgcagactaaggaacatattttgcttgctaagcaagtgggtgtccctaatatggttgttttcttgaacaaagaggaccaagttgatgatgaagagttgcttgagcttgttgagctggaggtaagagagttattgtcaagttatgagtttcctggtgatgatattcctattcattgtgggtctgcccttttggctttagaggctttaatggctaatcctactattaaaaggggtgatgatcaatgggttgataagatttataaattgatggactctgttgatgaatatattcctattccacaaagacaaactgaattacctttcttgatggctattgaagatgtgttttctattactggtagaggtacagtggctacagggagagtggaaagagggactgttaagacaggggaaattgttgatatagttggattgaaggacactaggaacactacagtaacaggagttgagatgtttcagaagatattggatgaagcaatggcaggagataatgtggggttgttgttgagaggtattcaaaagatcgatattcaaagaggaatggtgttggcaaaacctggatcaattactccacacaccaagtttgaagctttggtgtatgtgttgaagaaggaagagggtggcaggcattcccctttctttgctggttataggccacagttttacatgagaacaactgatgtgaccggaaaggttactgctattatgactgacaagggagaagaatctaagatggtcatgcctggtgatcgcgtaaacatggtggtcgagctcattatgccagtggcttgtgagcagggtatgaggttcgctattagggaaggaggaaagactgtcggagctggtgttattcagaaaatcttagaatgatgaacttgcagctgagcatcccttttcacatatggtcggatttttccattgaagtttattaatccattgtcatatatgcgactttttggttacttttgttatgtcttagaatcttactttagttgaagtatcctgttttatcgcccaattctactgaacttttgataatttttcccgtctcttgtttcacttatcatttgcttgaaagaaatgatatcatttgctctcatgccgaattcggcacgaggagaacctgtgcttttcgacacttccattattccttggtgggcatggatgaagagattccatctccctgaagctgaacttctcaatggtcgtgctgcaatggttggtttctttatggcctattttgtgga

SEQ ID NO: 308 - DNA, 1892 bp, Solanum lycopersicum
aggtagaaatggatagaaaaaatccctttgaaaatgagtactatatgagaggccctatttttttgctgccaaggatataatactgttaactcctcctcttctcacttcttccccaatttctttcaaatcccaatcctcactcttatccttctccgccatggcttcaatttcagcagcggctgccaccgccacttcttctcctaagctcctaaacccttctaatccccttcttccttccgctgctaaaccatctaagcttatcctatcctcttcatttacccccaacttttctacccttctcctccactcacccgccgctacttctcccactacccaccaccaacgccgcttcactgtccgtgctgcccgtggcaaattcgagaggaagaaaccccatgtcaatattggcactattggtcatgttgaccatggaaagactacccttactgctgctttaaccatggctcttgcttctatgggtaattccgctcccaagaagtatgatgaaattgatgccgccccagaagagcgtgctcgtgggattactattaatacggctacggttgagtatgagactgagaaccgacactatgcccacgtggactgccccggtcacgctgattatgtcaagaacatgattactggtgctgcccagatggatggagctattcttgttgtttccggtgctgatggcccaatgccacagaccaaagaacatatcttgcttgctaaacaagtgggtgttcctaatatggtggtgtttttgaacaaacaagatcaggttgatgatgaagagcttcttgagcttgttgagttggaggtaagagagcttttgtctagttatgagttccctggtgatgatattcctattgtttctggctctgctcttttggctttagaggctttaatggcaaatcctagtattaagagaggtgaaaatgaatgggttgataagatttttacattaatggacaatgttgatagttatattcctattccgcaaagacaaactgagttgccttttttgatggctattgaagatgtgttttcaatcactggtagaggtacagtggcaacagggagagtagagagagggactgttagggttggagagaccgttgatattgtaggattaagagacaccaggtctactaccgtgaccggggttgaaatgtttcagaagattttggatgaagcaatggctggtgataatgtgggattgttgttgagaggtattcagaagattgatattcaaagaggaatggtgttggcgaaaccgggaacaatcactcctcacaccaagtttgaagctcttgtgtatgttctgaaaaaggaggagggtggcaggcattccccattcttttcggggtataggcctcagttttacatgaggaccaccgatgtaactgggaaggttacttccattaccactgacaaaggggatgaatctaagatggtcatgcctggtgatcgtgtgaacttggtggttgagctcattatgcctgtcgcttgtgaacaagggatgagatttgccatcagggaaggaggaaagactgttggagctggtgtcattcagaaaattcttgagtgatcaacgagcagcagcgcatttccattcaaaatggtccggtccttgtcatgcaatatttttaatcccttgtcatatatgcaacgttttggttacttcttttcttttagatcataggttagttggagaaatcttgttataagtcaatgctagtgcacctttgcgagtttgcttcaatttttgtttgtttgtttgaaaagaagaacattttgtatcttgtgtatgtttagtttccatcaggaaaaatcatacttttgattgaaactcaacttaaacatgccaatgaaattaggtgcatttgata

SEQ ID NO: 309 - DNA, 1763 bp, Brassica napus
gattacaaagaaccacaacccaaaaacccgtaaacctctgatatttttttcttcttcttgtcaataatagtgaaccaaatggctcacattcacactaatggcaacatctctccttctttcccaaactcatattcaggggaagagcgtgaaatccaaaagaattactggaaagagcactcggtgggtctgagcgttgaggccatgatgcttgattccaaagctgctgacctcgacaaagaagaacggcctgagatactctcgcttcttccaccgattgaaggggaaaaggtgcttgagtttggcgctggcattggtcgtttcactagtgaattagctcagaaggccggccaggtcattgccgttgatttcattgaaagtgttatcaaaaagaatgaaaacattaatgggcactacaagaacgtcaaatttatgtgcgctgatgtcacatcccctgatatgaaattttcaagcgagtctatggatctgatcttctctaactggctgctcatgtatctctctgataaagaggttgaagatttggcgaaaaagatgttacaatggactaaggttggtgggtatattttctttagggagtcatgctttcatcaatctggtgacaacaagcggaagtacaacccaacacactaccgtgaacccaagttttacacaaagttattcaaagaatgccatatgaatgacgatgttgggaactcgtatgagttctctttggttagctgtaaatgcgttggagcttatgtgagaaacaaaaagaaccagaaccagatctgctggctttggcagaagaaagtcagttcggataatgataggggcttccaacggttcttggataatgtccagtataagtctagtggtatcttacgctatgagcgtgtctttggacaagggtttgtcagcacaggggggctcgagacgacaaaggagtttgtggctaagctggatctgaagccgggccagaaagttctagatgttggatgcggaatcggaggaggggacttctacatggctgagaactttgacgtggatgttgtaggcattgatctatctgtaaacatgatctcatttgccctcgaacacgcgataggactcaaatgctctgtggagttcgaagtagctgattgcaccaagaaggagtatcctgataacacctttgatgttatttacagcagagacaccatcctgcatatccaagacaagccagcattgttcagaacattctacaaatggttgaagcctggagggaaagttctcattactgattactgtagaagccccaaaacaccatctccagattttgcaaactacatcaagcaacgaggttatgatctccatgatgtacaagcatacggtcagatgctgaaagatgctggattcgatgacgtaatcgcagaggatagaaccgatcagttcatgaaagtcctgaaacgggaactggacgcagtggagaaagagaaggacgaattcatcagcgacttctctaaggaggactacgaggatattgttggtgggtggaactcaaagttactcaggagctcaagtggtgaacagaagtggggtttgttcatcgccaagaaaaactgattgtatagctttcttaatatttaaaacaaaataaatttggttatgtaagatacatcaagaccaagttccctcctatcctatcatctcttcaatctacatatgttgctttatccctctccatgtgtgtttttctttaatcatttaaatatacaagtgtggtgttg

SEQ ID NO: 310 - DNA, 1815 bp, Brassica napus
ggattacaaagaaccacaacccaaaaccgtaaacctcttatatttatttcttcttcttgtcaatagtgaaccaaatggctcacattcacactaatggcaacatctctccttctttcccaaactcatattcaggggaagagcgtgaaatccaaaagaattactggaaagagcactcggtgggtttgagcgttgaggccatgatgcttgattccaaagctgctgacctggacaaagaagaacgacctgagatactctcgcttcttccaccgattgaaggggaaacagtgctcgagtttggcgctggcattggtcgtttcactagtgaattagctcagaaggccggccaggtcattgcagttgatttcattgaaagtgttattaaaaagaatgaaaacattaatgggcactacaagaacgtcaaatttatgtgcgctgatgtcacatccccggatatgaaattctcaaacgagtctatggatctgatcttctctaactggctgctcatgtatctctctgataaagaggttgaagatttggcgaaaaagatgttacaatggacaaaggttggcgggtatattttctttagggagtcatgctttcatcagtctggtgacaacaagcggaagtacaacccaacacactaccgtgaacccaagttttacacaaagcttttcaaagaatgccatatgaatgacgatgttgggaactcgtacgaattctctttggttagctgtaaatgcgttggagcttatgtgaggaacaaaaagaaccagaaccagatctgctggctttggcagaagaaagtcagttcggataatgataggggcttccaacgcttcttggacaatgtccagtataagtctagtggtatcttacgctatgagcgtgtctttggacaaggctttgtgagcacagggggactcgagacgacaaaggagtttgtggctaagctggatctgaagccgggccagaaagttctagatgttggatgtggaataggaggaggggacttctacatggctgagaactttgacgtggatgttgtaggcattgatctatctgtaaacatgatctctttcgccctcgaacacgccataggactcaaatgctctgtggagttcgaagtagctgattgcaccaagaaggagtatcctgataacacctttgatgttatttacagcagagacaccattctgcatatccaagacaagccagcgttgttcagaacattctacaaatggttgaaacctggagggaaagttctcattactgattactgcagaagccccaaaacaccatctccagattttgcaaactacatcaagcaacgaggttatgatctccatgatgtacaagcatacggtcagatgctgaaagatgctggattcgatgaggtaatcgcagaggatagaaccgatcagttcatgaaagtcctgaaacgggaactggacgcagtggagaaggagaaggatgacttcattagtgacttctctaaggaagactacgaggatatcgtaggtgggtggaactcaaagctactcaggagctcaagtggtgaacagaagtggggcttgttcatggccaagaaaaactgattgtatggcatgcttaaaaattttaaacacataaataaataattgggctatgtaagatacatcaaaaccaagttccctcctatcatctccttcaagctatatatgttgctgcttttctttaatcatatatatatatatgtatatagtttggtgttttatgttgtgttatttgatatctgattgatcaaagtttgacacagaatttttttgatgcgttttt

SEQ ID NO: 311 - DNA, 1046 bp, Brassica rapa
  misc_feature (1042)..(1042): n is a, c, g, or t
  misc_feature (1044)..(1044): n is a, c, g, or t
ataagcaaatcagatctgatctgaaagctactgtttaaccatggacaaaggcataggtctttacccacttcatcgttgcaaaaccattcacctggtgagacatgctcagggggttcataatgttgctggagaaaaagaccatagtgcttactcttctgaggactattttgatgctcaggtcacccctcttggttggcaacaggtggatcatctacggaaccatgtcctagaaactcaactcttgaacaaagttgaacttgtcattgtctctcccttgcttagaactatacaaactgctgttggtgcttttggaggtggggaagatactaatggaacagatgcaacaccgctaatggtggccaacgcagggagcagcgaccgtcctgccatttcaggcttaaatagcccacctttccttgccgttgagctatgcagagaaactatgggtgatcatccctgtgacaggcgaagaagcgttacagagtacaaggctatgtttcctgcaatcgatttttcaattattgaaagcgacaaggatgttttgtggaagcctagtccaagagagaccccagatgaagttgcagctagaggtgtagagttcattaactggctatggacgaggaaagaaaaggagattgcaattgtatctcacagtggcttcttgcacggtctcttgagctctttcgggaaggattgtgttgaagacataaagaaagagttgtctatacacttcaagaactgtgagcttcgttcaatggttatcgtggatcaagggaacttggggactgattctacagagaccacaaactattctggcaaggttcctcaaggacttgatcatccaagcgactaatcgatcaagagtaagagagataaataacaagggaacacatgatggctccattggaatattattttggcattttcagctcgtattgtatttgataaacataagttaaattttagtatttgtatcggctactacatgatttactgattatgctggttgtttgaggaaaatgaataatttcaaaagttcatncntc

SEQ ID NO: 312 - DNA, 1142 bp, Brassica napus
gaaaactaaaaattatagaaagtggaagatccggcggtttaggatctctcctcctctcaatttatatatctcattttccaaggtaacatcagtttctataagcaaatcagatctgatctgaaagctactgtttaaccatggacaaaggcataggtctttacccacttcatcgttgcaaaaccattcacctggtgagacatgctcagggggttcataatgttgctggagaaaaagaccatagtgcttactcttctgaggactattttgatgctcaggtcacccctcttggttggcaacaggtggatcatctacggaaccatgttctagaaactcaactcttaaacaaagttgaacttgtcattgtctctcccttgcttagaactatacaaactgctgttggtgcttttggaggtggagaagatactaatggaacagatgcaacaccgctaatggtggccaacgcagggagcagcgaccgtcctgccatttcaggcttaaatagcccacctttccttgccgttgagctatgcagagaaactatgggtgatcatccctgtgacaggcgaagaagcgttacagagtacaaggctatgtttcctgcaatcgatttttcaattattgaaagcgacaaggatgttttgtggaagcctagtccaagagagaccccagaggaagttgcagctagaggtgtagagtttattaagtggctatggacgaggaaagaaaaggagattgcaattgtatctcacagtggcttcttgcacggtctcttgagctctttcgggaaggattgtgttgaagacataaagaaagagttgtctatacacttcaagaactgtgagcttcgttcaatggttatcgtggatcaagggaacttggggactgattctacagagaccacaaactattctggcaaggttcctcgaggacttgatcatccaagcgactaatcgatcgagagtaagagggataaataacaagggaacacatgatggctccattggaatattattttggtattttcagctcgtattgtatttgataaacataagttaaattttagtatttatgtcagctactacatgatttactgattatgctggttgtttgaggaaaatgaataaatttcagaaggttcattc

SEQ ID NO: 313 - DNA, 1157 bp, Raphanus sativus
ctcagttatatatctcattttccaaggtaacaccagtttctataagaaaatcagatctgatctgaaagctactgtttaaccaaccatggacaaaggcataggtctttacccacttcatcgttgcaaaaccattcacctggtgagacatgctcaggggattcataatgttgctggagaaaaagaccatagtgcttactcttccgaggactattttgatgctcatatcaccccacttggttggcaacaggtggatcatctacggaaccatgttttagaaactcaactcttaaacaaagttgaacttgtcattgtctctcccttgcttagaactatacaaactgctgtcggttcttttggaggcggagaagatactagtggagcagatgcaacaccgctaatggtggccaacgctgggagcagcgaccgtcctgccatttcaagcttaaacagcccacctttccttgctgttgagctatgcagagaaaccatgggtgatcatccctgtgacaggcgaagaagcgttacagagtacaaggctatgtttcctgcaatcgatttttcaattattgaaagcgacaaggatgttttgtggaagcctagtccaagagagaccccagatgaagttgcagcgagaggtgtagagttcattaactggctatggacgaggaaagaaaaggagattgcaattgtatctcacagtggcttcttgcacggtctactgagctcttacgggaaggattgtgtcgacgasataaagaaagaattgtctatacacttcaaaaactgtgagcttcgttcaatggttatcgttgatcaaggaaacctggggactaattctacagagactacaaactattctggcaaggttcctcaaggacttgatcatccaagcgcctaaccgatgacgagtaagagatataaataagaagggaacacctgatggctccattggaatattatttggcattttcagctcgtattgtattttgataaacataatttaaatttcagtatttatgtcagctactaaatgaatttactgattatggttkttatttggggaaaatgaataaatttcagaagtctcatcaatgttgtggctaaccagatttggtgtaagaggtgtaaaatcttctttttgttgcaaaaaaaaaaaa

SEQ ID NO: 314 - DNA, 1207 bp, Raphanus sativus
gtacttagcgcatatatatacggagttacggacaaggaaatacactaaaaaattaaaatatagaaacttgaagatccggcggtttaggatctctccccctctcagttatatatctcattttccaaggtaacatcagtttctataagaaaatcagatctgatctgaaagctactgtttaaccatggacaaaggcataggtctttacccacttcatcgttgcaaaaccattcacctggtgagacatgctcaggggattcataatgttgctggagaaatagaccatagtgcttactcttctgaggattattttgatgctcatatcaccccacttggttggcaacaggtggatcatctacggaaccatgttctagaaactcaactcttaaacaaagttgaacttgtcattgtctctcccttgcttagaactatacaaactgctgtcggtgcttttggaggcggagaagatactaatggagcagatgcaacaccgctaatggtggccaacgctgggagcagcgaccgtcctgccatttcaagcttaaacagcccacctttccttgctgttgagctatgcagagaaactatgggtgatcatccctgtgacaggcgaagaagcgttacagagtacaaggctatgtttcctgcaatcgatttttcaattattgaaagcgacaaggatgttttgtggaagcctagtccaagagagaccccagatgaagttgcagttagaggtgtagagttcattaactggctatggacgaggaaagaaaaggagattgcaattgtatctcacagtggcttcttgcacggtctcttgagctcttatgggaaggattgtgtcgacgacataaagaaagaattgtctatacacttcaagaactgtgagcttcgttcaatggttatcgttgatcaaggaaacctggggactaattatacagagactacaaactattctggcaaggttcctcaaggacttgatcatccaagcgactaatcgatgacgagtaagagatataaataagaagggaacacctgatggctcggctccattggaatattatttggcattttcagctcgtattattgtattttgataaacataatttaaattttcgtatttatgtcagctactaaatgaatttactgattatggttgttatttggggaaaatgaatmaatttcagaagtctcatcaatgttgtggcca

SEQ ID NO: 315 - DNA, 1113 bp, Arabidopsis thaliana
aaatggcgccacctcagatataagtaagagcacatagtagaccagaaaaaatcatcaaatccatctcccactcttctagcatcttgaagcttaaatctcagccgtccgatcatgccgatcagaaacatcgccattggccgtccagatgaagcaacccgtcccgatgccttaaaggcggcgttggctgagttcatttcaactttgatctttgtcgtcgccggttcaggctctggcatggctttcaacaagctcactgaaaacggagccaccactccttctggtctcgtagctgctgcactggctcatgcctttggactcttcgtcgctgtctcagttggtgccaacatctctggtggacacgttaaccctgccgtcactttcggtgctttcattggtggtaacatcactctcctccgtggtatcctctactggattgctcagcttctcggctccgtcgtcgcttgcctcatccttaaattcgccaccggtggcttggctgtgccggcttttggtctctctgctggagtaggagtgttgaacgctttcgttttcgagatcgtgatgacattcgggcttgtttacaccgtctacgctacagccattgaccccaaaaacgggagtcttggaacaattgctcccatcgcaatcggtttcattgttggagccaacatcttagctggaggagctttctctggagcctccatgaatcccgccgtggctttcggaccagcggtggtgagctggacatggaccaaccactgggtctactgggccggacctctcgtcggcggtggaatcgctggactcatctacgaagttttcttcatcaacaccacacacgagcagctcccaaccacagactactgaattaatctctctttttctctcttgtgtaattttattcgactttgaatttgaattttaatgtctttttaatttccgtttgtgtaatttcgaatcatcaaggggtttatgatcgttcgatcttttagatgaatccttgtccgttggtttcaagagtggccattgcaatttcgactatataatgtgaattatgtatcaatctcatcttaagttttcaagtgttgcaatatctctttttgccattttgtc

SEQ ID NO: 316 - DNA, 1025 bp, Brassica juncea
gagaccaatcactacacccaaaacgttttaacctccaaattaattctctccgatcatgccggccagaaacatcgccattggcggagtccaagcagaagtgactcaccccagcgcacttagagcagccctcgctgagtttatctcgactttgatctttgtcttcgccggctcaggctcaggaattgctttcaacaagctcactgacaatggagccaccactccttcaggccttgtcgccgctgccttagctcatgctttcggtctcttcgtcgctgtttctgtcggtgccaacatctccggtggacacgttaaccctgccgttaccttcggtgccttcctcggtggaaacatcactctcctccgtggtctcctctactggattgctcagcttcttggctcagtcgtcgcttgcttcctccttcagttcgccaccggtggcttggcagttccagcgttcggtctctcggcaggagttggaaccttaaacggtctcgtcttcgagatcgtgatgaccttcgggcttgtctacaccgtctacgccacagccatcgaccccaaaaacggtagcctcggaactatcgcacccatcgccattggtttcatcgtcggagctaacatcctcgctggtggagctttcagcggagcctccatgaacccagccgtcgctttcggaccagccgtcgtgagctggtcatggagtaaccactggatttactgggttggtcctcttgtcggtggtggactcgccggaatcatctacgactttgtttacatcatcgaaaacggtcacgagcaattgcccaccactgattactgaagacgctgaaaattactgttgtaatatgatttgtttttatttcgcatcgtaattgaatttctatgtggccgttggatcttctttttagatgaatccttgtccgttgatgtatgttgtatttgggtttgttgttggagttgtaattttccttgaaggctttttagacgaatgtgaattatgcatgcttctacattatattttcttctgg

SEQ ID NO: 317 - DNA, 1008 bp, Brassica juncea
tcactactctcaaaacgttttaacctcgaaccaattaattctctccgatcatgccgaccagaaacatcgccatcggcggagtccaagaagaagtgactcaccccagcgcacttagggcggccctcgctgagtttatctcgactttgatcttcgtcttcgccggctcaggctcaggaatcgctttcaacaagctcactgacaatggagccaccactccttcaggccttgtcgccgctgccttagctcatgctttcggtctcttcgttgctgtttctgtcggtgccaacatctccggtggacacgttaaccctgccgttaccttcggtgccttcctcggtggaaacatcactctcctccgtggtattctctattggattgctcagcttcttggctcagtcgccgcttgcttcctccttcagttcgccaccggtggcttggcagttccagcgttcggtctctccgcaggagttggaaccttaaacggcctcgtcttcgagatcgtgatgaccttcgggctcgtctacaccgtctacgccacagccatcgaccccaaaaacggtagcctcggaacaatcgcacccatcgccataggtttcatcgtcggagctaacatcctcgcgggtggagctttcagcggagcctccatgaacccagccgtcgctttcggaccagccgtcgtgagctggtcgtggagcaaccactggatttactgggttggtcctcttgtcggtggtggccttgccggaatcatctacgactttgtttacatcatcgaaaacgatcacgagcaattgcccaccactgattactgaagacgatgaaaattaaatgttgtggtatgatttgtttttatttctcatcgtaattgaatttctatgtggccgttggatcttctttttagatgaatccttgtccgttgatttatgttgtatttgggtttgttgttggagttgtaattttctttgaaggctttttagatcaatgtgaattatgcatgcttctacgtta

SEQ ID NO: 318 - DNA, 1075 bp, Brassica juncea
ggtagaccaatcactacacaaataaacccataactccctctctctctctcaaaacgttttaacttcaaaccaattagatctctccgatcatgccgatcagaaacatcgccatcggcggagtccaagaagaagtgactcaccccagcgcacttagggcggcgctcgctgagtttatctcgactttgatctttgtcttcgccggctcaggctccggcatcgctttcaacaagctcactgacaatggtgccaccactccttcaggcctcgtcgccgctgctttagctcatgcttttggtctcttcgttgctgtttccgtcggtgctaacatctccggtggtcacgttaaccccgccgttaccttcggtgctttcgtcggtgggaacatcactctcctccgtggtatcctctactggattgctcagcttcttggctcagtcgtcgcttgtctcctcctcaaattcgccaccggtggcttggcagttccagcttttggtctctctgctggagttgaatccttaaacggtttcgtcttcgagatcgtgatgaccttcgggctcgtctacaccgtctacgccacagccgtcgaccccaagaacggcagtctcggaacaatcgcaccaatcgccataggtttcattgttggagctaacatcctcgccggtggagctttcagcggagcctccatgaacccagccgtcgctttcggaccagccgtcgtgagttggacgtggaccaaccactggatctactgggctggtcctcttgtcggtggtggactcgctggactcatctacgaggttgtcttcatcaaccaaaacggtcacgagcaattgcccaccactgattactgaagactgccaaaaattcaatgtgatttgatttgtttttatttcgcatcgtaattgggtttctatgtggacgttggatcttttttagatgaatcgttgtatgttgattgtatggtgtatttgggtttgttgttggagtttgaatttctctggaaggcttttgtgcaatttcattgtacggtactaattaatggctataacctgggaatgtgaattcttatgcttct

SEQ ID NO: 319 - DNA, 1018 bp, Brassica juncea
actactctcaaaacgtttctaacctcaacccaattaactctctccaatcatgccgaccagaaacatcgccatcggcggagtccaagaagaagtgactcaccccagtgcccttagggcggccctcgccgagtttatctcgactttgatctttgtcttcgccggctcaggctcagggattgctttcaacaagctcactgacaatggagccaccactccttcaggccttgtcgccgctgccttagctcatgcttttggtctctttgtcgctgtttctgtcggtgccaacatctccggtggacacgttaaccctgccgttacctttggtgctttcctcggtggaaacatcactctcctccgtgggatttctttattggattgctcagcttcttggctcagtcgtcgcttgcttcctccttcagttcgccaccggtggcttggcagttccagcgttcggtctctccgcaggagttggaaccttaaacggtcttgtcttcgagatcgtgatgaccttcgggctcgtctacaccgtctacgccacagccatcgaccctaaaaacggtagcctcggaacaatcgcaccaatcgccataggtttcatcgtcggagctaacatcctcgccggtggagctttcagcggagcctccatgaacccagccgtcgctttcggaccagcagtcgtgagctggtcgtggagtaaccactggatttactgggttggtcctcttgtcggtggtggtctcgccggaatcatctacgactttgttttcatcatcgaaaatggccacgagcaattgcctaccactgattactgaaagaacgttctaaattaaatgttgtgagatatgatttgtttttatttctcatcgtaattgagtttctatgtgggtggccgttggatcttcttttttagatgaatccttgtccgttgatttatgtgttatttgggtttgttgttggagttgtaattttatttgaaggctttttagatgaatgtgaattatgcatgcttctacgttaa

SEQ ID NO: 320 - DNA, 860 bp, Brassica juncea
  misc_feature (4)..(4): n is a, c, g, or t
tacncggggatctcacactcttaataacattcacaacatttaatctcagccgttcgatcttcctcccatcatgccgatcagaaacatcgccgttggccgtcccgaggaggccacccgtcccgacgccttaaaggcggcgttggctgagtttatatcaactatgatctttgtcttcgccggctcaggctccggaatggctttcaacaagctcactgaaaacggtgccaccactcccgctggcctcgtagccgcctcgctggcacatgctttcggactctttgtcgccgtctccgtcggcgccaacatctccggtggacacgttaaccctgccgtcacattcggcgctttcgttggtggcaacatcactctcctccgtggtatactctactggattgctcagctacttggctcagtcgttgcttgtctcctcctcaagttcgccactggcggtttggtggtgccggcttttggcctctctgccggagtaggagtatccaacgctttggttttcgagatcgtgatgaccttcgggcttgtttacacagtctacgccaccgccgtcgaccccaagaacggaagtcttggaaccatcgctcccatcgcaattggtttcatcgtcggtgccaacatcttagcaggaggagcctttagcggagcctccatgaaccccgccgtggctttcggaccagcggtggtaagctggtcgtggagcaaccactgggtctactgggccggacctcttgttggcggtggactcgctggactcatctacgaggttttcttcatcaacaccactcacgaacagctcccagccaccgactactgaatcaatctctctgtatctctcatgtgtaatttga

SEQ ID NO: 321 - DNA, 981 bp, Brassica juncea
tcaacgcagagtacgcggggatctcactcttctaacattcacaacatttaatctcagccgttcgatctttctccgaccatgccgatcagaaacatcgccgttggaagtcccaatgaggccacccgtcccgacgccttaaaggcggcgttggctgagtttatttcaactatgatctttgtcttcgccggctcaggctcaggaatggctttcaacaagctcactgaaaatggagccaccactcccgccggtctcgtagctgcctcaatggcacacgcttttggactctttgttgctgtctcagttggcgccaacatctccggcggacacgttaaccccgccgtcactttcggcgctttcgttggtggaaacatcactctcctccgtggtatactctactggattgctcagctactcggctcagtcgttgcttgtctcctgctcaagttcgccaccggcggtttggttgtgccggcttttggcctctccgccagagttggagtgtcgaacgctttggttttcgagatcgtgatgaccttcgggcttgtttacacagtctacgccaccgccgttgatcccaagaacggaagtcttggaacaatagctcccatagcaattggtttcattgttggtgccaacatcttagcaggaggagcctttagcggagcctcaatgaaccccgccgtggctttcggaccagctgtggtaagctggtcgtggaacaaccactgggtttactgggccggacctcttgttggcggtggactcgctggactcatctacgaggttttcttcatcaacaccactcacgaacagctccccaccaccgactactgaatcaatctctctgtttctctcatgtgtaatttgatttgtcgtctttgaattttaatgcttttttgtcttttgcgtttgtgtaatttcgcatcagcatggctttatgaccgttggatcttttacagatgaatcattttctgttgatta

SEQ ID NO: 322 - DNA, 1058 bp, Brassica oleracea
gacgcgtgggcaaaacgttttaattaacctcgaatcaatttattctctcccatcatgccgaccagaaacatcgccatcggcggagtccaagaagaagtgactcaccccagcgcacttagggcggccctcgctgagtttatctcgactttgatctttgtcttcgccggctcaggctcaggaattgctttcaacaagctcactgacaatggagccaccactccttcaggccttgtcgccgctgccttagctcatgctttcggtctcttcgtcgctgtttctgtcggtgccaacatctccggtggacacgttaaccctgccgttaccttcggtgccttcctgggtggaaacatcactctcctccgtggtctcctctactggattgctcagcttcttggctcagtcgtcgcttgcttcctccttcagttcgccaccggtggcttggcagttccagcgttcggtctctccgcaggagttggaaccttgaatggtctcgtcttcgagatcgtgatgaccttcgggctcgtctacaccgtctacgccacagccatcgaccccaaaaacggtagcctaggaacaatcgcacccatcgccattggtttcatcgtcggagctaacatccttgctggtggagctttcagcggagcctccatgaacccagccgtcgctttcggaccagccgtcgtgagctggtcatggagtaaccactggatttattgggttggtcctcttgtcggtggtggactcgccggaatcatctacgactttgtttacatcatcgaaaacggccacgagcaattgcccaccactgattactgaagacgttcaaaattaaatgttgtgatatgatttgtttttattttctcatcgtaattgaatttctatgtggccgttggatcttctttttagatgaatccttgtccgttgatgtatgttgtatttgggtttgttgttggagttgccttgaaggctttttagacgaatgtgaattatgcatgcttctacttttattttcttctttatttcttgtttttttaaactttataatccttatcaagaga

SEQ ID NO: 323 - DNA, 1032 bp, Brassica oleracea
gcgtccgcatcacaacatttaatctcagccgttcgatctttctccgaccatgccgatcagaaacatcgccgttggacgtcccgatgaggccacccgtcccgacgccttaaaggcggcgttggctgagtttatttcaactatgatctttgtcttcgccggctcaggctcaggaatggctttcaacaagctcactgaaaacggagccaccactcccgccggtctcgtagctgcctcactggcacacgctttcggactctttgtcgctgtctcagttggcgccaacatctccggtggacacgttaaccctgccgtcacgttcggagctttcgtaggtggtaacatcactctcctccgtggtatactctactggattgctcagctacttggctcagtcgttgcttgtctcctcctcaagttcgccaccggcggcttggttgtgccggcttttggcctctctgccggagttggagtgtcgaacgctttggttttcgagatcgtgatgaccttcgggctagtttacacagtctacgccaccgccgttgatcccaagaacggaagtcttggaacaatagctcccatcgctatcggtttcattgttggtgccaacatcttagccggaggagcattcagcggagcctccatgaaccctgctgtggctttcggaccagcggtggtaagctggtcgtggaacaaccactgggtctactgggccggacctcttgttggcggtggactcgctggactcatctacgaggttttcttcattaacaccacccacgaacagctccccaccgccgactactgaatcaatctctctgtttctctcatgtstamttwgatttgtygtctttgaattttaatgttttttttttgcgtttgtgtaatttggcatcatcatgtgtttatgaccgttggatctgttcaaatgaatccttttctgttgaaaaaaaaaatactgtgaattaccgattacgtatctatctcatcttaagcttgtcccaattgtatgccatttttccatcttgaatgtcc

SEQ ID NO: 324 - DNA, 961 bp, Brassica rapa
ctggatctcactcttctaacattcacaacatttaatctcagccgttcgatctttctccgaccatgccgatcagaaacatcgccgttggaagtcccaatgaggccacccgtcccgacgccttaaaggcggcgttggctgagtttatttcaactatgatctttgtcttcgccggctcaggctcaggaatggctttcaacaagctcactgaaaatggagccaccactcccgccggtctcgtagctgcctcactggcacacgcttttggactctttgttgctgtctcagttggcgccaacatctccggcggacacgttaaccccgccgtcactttcggcgctttcgttggtggaaacatcactctcctccgtggtatactctactggattgctcagctactcggctcagtcgttgcttgtctcctgctcaagttcgccaccggcggtttggttgtgccggcttttggcctctccgccggagttggagtgtcgaacgctttggttttcgagatcgtgatgaccttcgggcttgtttacacagtctacgccaccgccgttgatcccaagaacggaagtcttggaacaatagctcccatagcaattggtttcattgttggtgccaacatcttagcaggaggagcctttagcggagcctcaatgaaccccgccgtggctttcggaccagctgtggtaagctggtcgtggaacaaccactgggtttactgggccggacctcttgttggcggtggactcgctggactcatctacgaggttttcttcatcaacaccactcacgaacagctccccaccaccgactactgaatcaatctctctgtttctctcatgtgtaatttgatttgtcgtctttgaattttaatgctttttttgtcttttgcgtttgtgtaatttggcatcatcatgtgtttatgactgttggatctttcaaatgaatccttttctgttga

SEQ ID NO: 325 - DNA, 803 bp, Brassica rapa
agaccaatcactacacaaataaacccataactctctctctctctctctcaaaacattttaacttcaaaccaattaactcccatcgatcatgccgatcagaaacattgccatcggcggagtccaagaagaagtgactcaccccagcgcacttagggcggcgctcgctgagtttatctcgactttgatctttgtcttcgccggctcaggctccggaatcgctttcaacaagctcactgacaatggtgccaccactccttcaggcctcgtcgccgctgctttagctcatgctttcggtctattcgtcgctgtttccgtcggtgctaacatctctggtggtcacgttaaccccgccgttaccttcggtgctttcgtcggtgggaacatcactctcctccgtggtatcctctattggattgctcagcttcttggctcagtcgtcgcttgtctcctccttaaattcgccaccggtggcttggcagttccagcttttggtctctctgctggagttgaatccttaaacggtttcgtcttcgagatcgtgatgaccttcgggcttgtctacaccgtctacgccacagccgtcgaccccaagaacggtagtctcggaacaatcgcaccaatcgccataggtttcatcgtcggagctaacatcctcgctggtggagctttcagcggagcctccatgaacccagccgtggcttttggaccagccgtcgtgagctggacgtggaccaaccactggatctactgggctggtcctcttgtcggtggtggactcgctggactcatctacgagtttgtct

SEQ ID NO: 326 - DNA, 1180 bp, Brassica rapa
aaatttccttataagttctcgtatttctattaaactattttggctcccatatttcataataacaaaactattatttgtatgacagagaagaaatggttttatctacacttttgacataagacacacatacttggctatatatatacacctaagcacacaaaagaaaaccagaccaatcactactctcaatacgttttaacctcgaaccaattaattctctccgatcatgccgaccagaaacatcgccatcggcggagtccaagaagaagtgactcaccccagcgcacttagggcggccctcgctgagtttatctcgactttgatcttcgtcttcgccggctcaggctcaggaatcgctttcaacaagctcactgacaatggagccaccactccttcaggccttgtcgccgctgccttagctcatgctttcggtctcttcgtcgctgtttctgtcggtgccaacatctccggtggacacgttaaccctgccgttaccttcggtgccttcctcggtggaaacatcactctcctccgtggtctcctctactggattgctcagcttcttggctcagtcgtcgcttgcttcctccttcagttcgccaccggtggcttggcagttccagcgttcggtctctcggcaggagttggaaccttaaacggtctcgtcttcgagatcgtgatgaccttcgggcttgtctacaccgtctacgccacagccatcgaccccaaaaacggtagcctcggaactatcgcacccatcgccattggtttcatcgtcggagctaacatcctcgctggtggagctttcagcggagcctccatgaacccagccgtcgctttcggaccagccgtcgtgagctggtcatggagtaaccactggatttactgggttggtcctcttgtcggtggtggactcgccggaatcatctacgactttgtttacatcatcgaaaacggtcacgagcaattgcccaccactgattactgaagacgctgaaaattactgttgtaatatgatttgtttttatttcgcatcgtaattgaatttctatgtggccgttggatcttctttttagatgaatccttgtccgttgatgtatgtttgtatttgggtttgttgttggagttgtaattttccttgaaggctttttagacgaatgtgaattatgcatgcttctac

SEQ ID NO: 327 - DNA, 1089 bp, Brassica napus
tgaggaccggtccggaattcccggcacaaataaaccataactctctctctctcaaaacattttaacttcaaaccaattamytctcaccgatcatgccgatcagaaacatcgccatcggcggagtccaaggagaagtgactcaccccagcgcacttagggcggcactcgctgagtttatctccactttgatctttgtcttcgccggctcaggatccggaatcgctttcaacaagctcactgacaatggtgcgaccactccttcaggcctcgtcgccgctgctttagctcatgctttcggtctcttcgtcgctgtttccgtcggtgctaacatctctggtggtcacgttaacccagccgttaccttcggtgctttcgtcggtggaaacatcactctcctccgtggtatcctctattggattgctcagcttcttggctcagtcgtcgcttgtctcctccttaaattcgccaccggtggcttggcagttccagcttttggtctctctgctggagttgaatccttaaacggtttcgtcttcgagatcgtgatgaccttcgggctcgtctacaccgtctacgccacagccgttgaccccaagaacggtagtctcggaacaatcgcaccaatcgccataggtttcatcgttggagctaacatcctcgccggtggagctttcagcggagcctccatgaacccagccgtggcttttggaccagccgtcgtgagctggacgtggaccaaccactggatctactgggctggtcctcttgtcggtggtggactcgctggactcatctacgagtttgtcttcatcaaccaaaacggccacgagcaattgcccaccactgattactgtctactgaagactgccaaaactcaatatgatttgatttgtttttatttcgcatcgtaatggggtcgttggatcttttttagatgaatcgttgtatgttgattttattgtgtatttgggtttgtcgttggagttttagttccctggaatgcttttgtgcaattgtattgtacggtacggtacggtactgatgactatgaatgataaaaccagggaatgtgaattacccaagcttcta

SEQ ID NO: 328 - DNA, 1085 bp, Brassica napus
ataccagtcactactctcaaaacgttttaattaacctcgaatcaatttattctctcccatcatgccgaccagaaacatcgccatcggcggagtccaagaagaagtgactcaccccagcgcacttagggcggccctcgctgagtttatctcgactttgatctttgtcttcgccggctcaggctcaggaattgctttcaacaagctcactgacaatggagccaccactccttcaggccttgtcgccgctgccttagctcatgctttcggtctcttcgtcgctgtttctgtcggtgccaacatctccggtggacacgttaaccctgccgttaccttcggtgccttcctgggtggaaacatcactctcctccgtggtctcctctactggattgctcagcttcttggctcagtcgtcgcttgcttcctccttcagttcgccaccggtggcttggcagttccagcgttcggtctctccgcaggagttggaaccttgaatggtctcgtcttcgagatcgtgatgaccttcgggctcgtctacaccgtctacgccacagccatcgaccccaaaaacggtagcctaggaacaatcgcacccatcgccattggtttcatcgtcggagctaacatccttgctggtggagctttcagcggagcctccatgaacccagccgtcgctttcggaccagccgtcgtgagctggtcatggagtaaccactggatttattgggttggtcctcttgtcggtggtggactcgccggaatcatctacgactttgtttacatcatcgaaaacggccacgagcaattgcccaccactgattactgaagacgttcaaaattaaatgttgtgatatgatttgtttttattttctcatcgtaattgaatttctatgtggccgttggatcttctttttagatgaatccttgtccgttgatgtatgttgtatttgggtttgttgttggagttgccttgaaggctttttagacgaatgtgaattatgcatgcttctacttttattttcttctttatttcttgtttttttaaactttataatccttatcaagagaataacttttattttgatatt

SEQ ID NO: 329 - DNA, 1030 bp, Brassica napus
accatctcactcttctaacattcacaacatttaatctcagccgttcgatctttctccgaccatgccgatcagaaacatcgccgttggaagtcccaatgaggccacccgtcccgacgccttaaaggcggcgttggctgagtttatttcaactatgatctttgtcttcgccggctcaggctcaggaatggctttcaacaagctcactgaaaatggagccaccactcccgccggtctcgtagctgcctcactggcacacgcttttggactctttgttgctgtctcagttggcgccaacatctccggcggacacgttaaccccgccgtcactttcggcgctttcgttggtggaaacatcactctcctccgtggtatactctactggattgctcagctactcggctcagtcgttgcttgtctcctgctcaagttcgccaccggcggtttggttgtgccggcttttggcctctccgccggagttggagtgtcgaacgctttggttttcgagatcgtgatgaccttcgggcttgtttacacagtctacgccaccgccgttgatcccaagaacggaagtcttggaacaatagctcccatagcaattggtttcattgttggtgccaacatcttagcaggaggagcctttagcggagcctcaatgaaccccgccgtggctttcggaccagctgtggtaagctggtcgtggaacaaccactgggtttactgggccggacctcttgttggcggtggactcgctggactcatctacgaggttttcttcatcaacaccactcacgaacagctccccaccaccgactactgaatcaatctctctgtttctctcatgtgtaatttgatttgtcgtctttgaattttaatgctttttttgtcttttgcgtttgtgtaatttggcatcatcatgtgtttatgactgttggatctttcaaatgaatccttttctgttgatttccagagtgataattgcaaatattgtgaattatgtatccatatcatcttaagcttgtgtcatttcctc

SEQ ID NO: 330 - DNA, 1001 bp, Brassica napus
ctctcaatacgttttaacctcgaaccaattaattctctccgatcatgccgaccagaaacatcgccatcggcggagtccaagaagaagtgactcaccccagcgcacttagggcggccctcgctgagtttatctcgactttgatcttcgtcttcgccggctcaggctcaggaatcgctttcaacaagctcactgacaatggagccaccactccttcaggccttgtcgccgctgccttagctcatgctttcggtctcttcgtcgctgtttctgtcggtgccaacatctccggtggacacgttaaccctgccgttaccttcggtgccttcctcggtggaaacatcactctcctccgtggtctcctctactggattgctcagcttcttggctcagtcgtcgcttgcttcctccttcagttcgccaccggtggcttggcagttccagcgttcggtctctcggcaggagttggaaccttaaacggtctcgtcttcgagatcgtgatgaccttcgggcttgtctacaccgtctacgccacagccatcgaccccaaaaacggtagcctcggaactatcgcacccatcgccattggtttcatcgtcggagctaacatcctcgctggtggagctttcagcggagcctccatgaacccagccgtcgctttcggaccagccgtcgtgagctggtcatggagtaaccactggatttactgggttggtcctcttgtcggtggtggactcgccggaatcatctacgactttgtttacatcatcgaaaacggtcacgagcaattgcccaccactgattactgaagacgctgaaaattactgttgtaatatgatttgtttttatttcgcatcgtaattgaatttctatgtggccgttggatcttctttttagatgaatccttgtccgttgatgtatgtttgtatttgggtttgttgttggagttgtaattttccttgaaggctttttagacgaatgtgaattatgcatgcttctacgtt

SEQ ID NO: 331 - DNA, 1076 bp, Brassica napus
aaatggcgccacctcagatataagtatgagcagagagtagaccagaaaaaccatctcactcttctaacattcacaacatttaatctcagccgttcgatctttctccgaccatgccgatcagaaacatcgccgttggaagtcccaatgaggccacccgacccgacgccttgaaggcggcgttggctgagtttatatcaactatgatctttgtcttcgccggctcaggctcaggaatggctttcaacaagctcactgaaaacggagccaccactcccgccggtctcgtagctgcctcactggcacacgcttttggactctttgtcgccgtctcagttggcgccaacatctccggtggacacgttaacccagccgtcacgttcggagctttcgtaggtggtaacatcactctcctccgtggtatactctactggattgctcagctacttggctcagttgtggcttgtctcctcctcaagttcgccactggcggtttggttgtgccggcttttggcctctccgccggagttggagtgtcgaacgctttggttttcgagatcgtgatgacctttgggctggtttacacagtctacgccaccgccgttgatcccaagaacggaagtcttggaacaatcgctcccatcgctatcggtttcattgtcggtgccaacatcttagccggaggagcattcagcggagcctcaatgaaccccgccgtggctttcggaccagcggtggtaagctggtcgtggaacaaccactgggtctactgggccggacctcttgttggcggtggactcgctgggctcatctacgaggttttcttcatcaacaccactcacgaacagctccccaccaccgactactgaatcaatctctctgtttctctcatgtgtaatttgatttgtcgtctttgaattttaatgctttttttgtcttttgcgtttgtgtaatttggcatcatcatgtgtttatgaccgttggatctttcaaatgaatccttttctgttgaaatgaatccttttctgttgatttccagagtgataattgcaaatattgtaattatgtatccatccagc

SEQ ID NO: 332 - DNA, 1148 bp, Brassica napus
acttggtgcgactgcaggtaccggttccggattcccgcgtcgacccacgcgtccgcaaataaacccataactctctctctctctctctcaaaacattttaacttcaaaccaattaactcccatcgatcatgccgatcagaaacattgccatcggcggagtccaagaagaagtgactcaccccagcgcacttagggcggcgctcgctgagtttatctcgactttgatctttgtcttcgccggctcaggctccggaatcgctttcaacaagctcactgacaatggtgccaccactccttcaggcctcgtcgccgctgctttagctcatgctttcggtctattcgtcgctgtttccgtcggtgctaacatctctggtggtcacgttaaccccgccgttaccttcggtgctttcgtcggtgggaacatcactctcctccgtggtatcctctattggattgctcagcttcttggctcagtcgtcgcttgtctcctccttaaattcgccaccggtggcttggcagttccagcttttggtctctctgctggagttgaatccttaaacggtttcgtcttcgagatcgtgatgaccttcgggcttgtctacaccgtctacgccacagccgtcgaccccaagaacggtagtctcggaacaatcgcaccaatcgccataggtttcatcgtcggagctaacatcctcgctggtggagctttcagcggagcctccatgaacccagccgtggcttttggaccagccgtcgtgagctggacgtggaccaaccactggatctactgggctggtcctcttgtcggtggtggactcgctggactcatctacgagtttgtcttcatcaaccaaaacggccacgagcaattgcccaccactgattactgaagactgccaaaactcaatgtgatttgatttgtttttatttcgcatcgtaatggggtttctttgtggtcgttgaatcttttttagatgaatcgttgtatgttgattttattgtgtatttgggtttgtcgttggagttttagttccctggaatgcttttgtgcaattgtattgtacggtactaatggctataaattataaaaccagggaatgtgaattaccatgcttctaatagtttttgcagaaaaacttccttaaatt

SEQ ID NO: 333 - DNA, 1064 bp, Raphanus sativus
ggagaccaatcactacacaaataaacccacaactctccttatcaaaaacattgtaacctcaaaccaattaaatctctccgatcatgccgataagaaacatcgccatcggcggagtccaagaagaagtgactcatcccagcgcacttagggcggcgctggctgagtttatctcgactttgatctttgtcttcgccggctcaggctccggtatcgctttcaacaagctcactgacaatggagcgaccactccttcaggactcgtagccgctgcattagctcatgctttcggtctcttcgtcgctgtttccgtcggtgctaacatctctggtggtcacgttaaccctgccgttaccttcggtgctttcgtcggtgggaacatcactctcctccgtggtatcctctattggattgctcagcttcttggctcagtcgtcgcttgtctcctccttaaattcgccaccggtggcttggcagttccagcttttggtctctctgctggagttgaatccttaaacggatttgtcttcgagatcgtgatgaccttcgggctcgtctacaccgtttacgccacagccgtcgaccccaagaacggtagtctcggaacaatcgcaccaattgccataggtttcatcgttggagctaacatcctcgccggtggagctttcagcggagcctccatgaacccagccgtcgcttttggaccagccgtcgtgagctggacgtggaccaaccactggatctactgggccggccctcttgtcggtggtggactcgctggactcatctacgagtttgtcttcatcaaccaaaacggtcacgagcaattgccaaccactgattactgaagactgccaaaattcaatgtgacttgatttgtttttattttgcatcgtaatgggatttctatgtggtcgttggatctttttagatgaattgttgtatgttgattgcatggtgtatttgggtttgttgttggagttttaaattccctggaagacttttgtgcaattttattgtactaatataaatgataaaaccagggaatgtgaattatcatgcttcga

SEQ ID NO: 334 - DNA, 1032 bp, Raphanus sativus
ggggagaccaatcaccacataaataaacccatcagaaaacgttttaacctaaatctctacgatcatgccggccagaaacattgccatcggcggagtccaagaagaagtgactcaccccagcgcacttagggcggccctcgctgagtttatctcgactttgatctttgtcttcgccggctcaggctcaggaattgctttcaacaagctcactgacaatggagccaccactccttcaggccttgtcgccgctgccttagctcatgctttcggtctcttcgtcgctgtttctgtcggtgccaacatctccggtggacacgttaaccctgccgttaccttcggtgccttcctcggtggaaacatcactctcctccgtggccttctctattggattgctcagcttcttggctcagtcgccgcttgcttcctccttcaattcgccaccggtggcttggcagttccagctttcggtctctctgctggagttggaaccttgaacggtctcgtcttcgagatcgtgatgaccttcgggctcgtctacaccgtctacgccacagccatcgaccccaaaaacggtagcctcggaacaatcgcaccaatcgcaataggtttcatcgtcggagctaacatcctcgcgggtggagctttcagcggagcctccatgaacccagccgtcgcttttggaccagccgtcgtgagctggtcgtggagcaaccactggatttactgggttggtcctcttgttggtggtggtctcgctggaatcatctacgactttgtttacatcatcgaaaacggtcacgagcaattgcccaccactgattactgaagacgctgaaaattaaatgttgtgatatgatttgtttttaattctcatcgtaattgaatttctgtgtgaccgttggatcatctttttagatgaatccttgtccgttgatttatgttgtatttgggtttgttgttggagttgtaattttcattgaaggctcttttagatgaatgtgaattatgcatgcttctacgttatattttctt

SEQ ID NO: 335 - DNA, 1004 bp, Raphanus sativus
ggatctcactctcttctaacacacacaacatttaatctcagccgttccatctttctcccatcatgccgatcagaaacatcgccgttggccgtcccgatgaggccacccgccccgacgccttaaaggcggcgttggctgagttcatatcaactatgatctttgtcttcgccggctcaggctcaggaatggctttcaacaagctcactgaaaacggtgccaccactcccgccggcctcgtagccgcctcactggctcacgctttcggactctttgtcgccgtctccgtcggcgccaacatctccggtggacacgttaaccccgccgtcactttcggcgctttcgttggtggcaacatcactctcctccgtggtatactctactggattgctcagctactcggctcagtcgttgcttgtctcctcctcaagttcgccaccggcggtttggctgtgccggcttttggcctctccgccggagtaggagtgtccaacgctttggttttcgagatcgtgatgaccttcgggcttgtttacacagtctacgccaccgccgtcgaccccaagaacggaagtcttggaaccatcgctcccatcgcaatcggtttcattgtcggtgccaacatcttagcaggaggagcattcagcggagcctccatgaaccccgccgtggctttcggaccagctgtggtaagctggtcgtggaacaaccactgggtctactgggccggacctcttattggcggtggaatcgctggactcatctacgaggttttcttcatcaacaccacccacgaacagctccccaccaccgactactgaatcaatctctctgtttctctcatgtgtaatttgatttgtcgtctttgagttttaatgcttttttccgtttgtgtaatttcgcatcagcatggctttatgaccgttggatcttttcagattaatcatttttctgttgatttccagagttgtaattgcagatattgtgaattatgtatctatctcatc

SEQ ID NO: 336 - DNA, 1071 bp, Raphanus sativus
ggatctcactctcctaacacacacaacatttaatctcagccgctcgatcttcctcccatcatgccgatcagaaacatcgccgttggccgtcccgatgaggccacccgtcccgacgccttgaaggcagcgttggctgagttcatatcaactatgatctttgtcttcgccggctcaggctccggaatggctttcaacaagctcactgaaaacggtgccaccactcccgccggcctcgtagccgcctcactggcccacgcttttggactctttgtcgccgtctccgtcggcgccaacatctccggtggacacgtcaaccccgccgtcacgttcggcgcttttgttggtggcaacatcactcttctccgcggtatactctactggattgctcagctacttggctcagtcgttgcttgtctcctcctcaagttcgccaccggcggtttggttgtgccggcttttggcctctccaccggagtaggagtgtccaacgctttggttttcgagatcgtgatgaccttcgggcttgtttacacagtctacgccaccgccatcgaccccaagaacggaagtcttggaaccatcgctcccatcgcaatcggtttcatcgtcggtgccaacatcttagcaggaggagcattcagcggagcctccatgaaccccgccgtggccttcggaccagctgtggtaagctggtcgtggaacaaccactgggtctactgggccggacctcttattggcggtggaatcgctggactcatctacgaggttttcttcatcaacaccacccacgaacagctccccaccaccgactactgaatcaatctctctgtttctctcatgtgtaatttgatttgtcgtctttgagttttaatgctttttccgtttgtgtactttcgcatcagcatggctttatgaccgttggatcttttcagattaatcatttttctgttgatttccagagttgtaattgcagatattgtgaattatgtatctatctcatcttaagctttgtgccatttcgtctattttgaatatgtccttgtcactttattaagacattaacttaaacca

SEQ ID NO: 337 - DNA, 1080 bp, Thellungiella halophila
gagaccaatcactacatagacaaacacaaaaaaaccaccactaaaccatttgaaactctccgatcatgccgatcagaaacatcgccatcggcggagtccaagaagaagtgactcacccaagcgcacttagggcggctctcgccgagtttatctcaacgttgatatttgttttcgccggctcaggctccggaattgctttcaacaagctcactgacaatggagccaccactccttccggcctcgtcgccgctgccttagctcatgctttcggtctcttcgtcgctgtttccgtcggtgctaacatctccggtggtcacgttaatcccgccgttaccttcggtgccttcctcggtggtaacatcactctcctccgtggtattctctactggatcgctcagcttcttggctccgtcgtcgcttgtttcctccttactttcgccaccggtggcttggcggttccggcgttcggtctctctgccggagttggatcattaaacgcattcgtcttcgagatcgtgatgaccttcgggctcgtctacacagtctacgcaaccgccatcgaccccaaaaacggaagtctcggaacaatcgcaccaatcgccattggtttcatcgtcggagcaaacatcctcgccggtggagctttcagtggagcctccatgaacccagccgtcgctttcggaccagccgtcgtgagctggtcgtggagcaaccactgggtttactgggctggtcctcttgtcggtggtggactcgccggactcatttacgagtttgttttcatcggcggaaacgaccatgagcaattgcccaccactgattattgaagacccaaaaaaaaaaaaaaaaaaaaaaattcgatgttgtgatttgatttgtttctgtttcgcatcgtgattgggtttctttgtgaccgttggatctttttttagatgaatctttgtatgttgattaatgttgtatttgggtttgttgttggagtttttatttccctggaaggcttttgtctttgtgcaattgtattgtacggtattaatgactatatatatgataaaaccaggggatgtgaattatgctacg

SEQ ID NO: 338 - DNA, 1120 bp, Brassica napus
gaacaggaggagatagatagtcggaggagctcgaggaggaggagccgagaaatcaaaattagggctaaactttgccggaaatctcaaaaagataaaaactttaatggcgaggacgggaaccgcgaagaagaacggggcggggcaattcttcctagcgacgctgcttctatggctagtctccgtcgtgtttgagattgcattcaacctaagaacagagcttctctgggtgattggcggcggatgcttctttcaatcggtgaattggttcgttcgctcttgcctctctcgcgaccctctcttcgtcaacacctccgtctcgcttctacactcaatcatcacctccgcctcagtggttttcattctgctcaaccaatgcttagccaaaggtgtagacgagatgttcgatcattckgagctcgttggtgggagttggagatgggcgtaccaagctttgtgtttctcttgcggctactttgcttatgaccagtgggatatgcttcagtaccggttgtacagcggcttgatcccttccattctcgttcaccacctcgtcctcctcgtttgcttcactttggctctttaccgtaacgttaccatcaactacctcatcctcactctcatttgcgagatgcattcgatctttctgcacgtgaggaagctgaggaggatggcgggaatccgagacagcaacacggcgttggtgaaactsgagtgggtwttaaactggacggcctttgtttttgcgaggtgcgttcctcacattctcatcactgtcaagctgatcaaagacgcgcrtaagtttgagaggggcgtggagtggccgctcgctctgtttggtatggctggaatgaatatactcaatgtgggtcttggaatggatctgttccatgcttttagaagagagagaagcaacagaagaaatcaagagaagagcaaccatgtagaatgatttagccagtttcggaagccatcatcaactgaatccaaggtttattgtaatacacattacacactcttttttttttctttttctgaggctttgctactatgtcctattagctttcagatttttgcatgtactataaggaaaaactacatgtaaatgttatttgttgatcag

SEQ ID NO: 339 - DNA, 1155 bp, Raphanus sativus
gggataaacgtcggagcttgaggaagggcctatrgccagagccgctaaaagaaaataaattaaattagggctataaactttaccgggaagataacttttgatggcgaggacgggaactgggaagaacggtgcggggcaattcttcctggcgacgctgcttctatggctagtctccgtcgtgttcgagattgccttcaacctaaggaccgagcttctctgggtgatcagcggaggatgcttctttcaatcggcgaattggtttgttcgtgcttgcctctctcgtgaccctctcttcgttaacacctccgtctcgctcctacactcaatcatcacctccgcctcagtggttttcattctgctcaaccaatgcttagagaaaggtgtagacgagatgttcgatcattctgagctcgttggtgggrcttggaactgggcacaccctgctctgtgtttctcttgcggttactttgcttatgaccagtgggatatgcttcggtaccgtttatacagcggyttaataccttctatcctggtccaccatctcgtcctcctcgtttgcttcactttggctctgtaccggaacgtcaccatcaactacctcatccttactctcatttgcgagatgcattcgatctttctgcacgtgaggaagctaaggaggatggcgggaatccgtgacagcggcacggcgttggtgaaactggagtgggtactaaactggacggcctttgtgtttgcgagatgcattcctcacattctcatcactgtcaagctgatcaaagacgcgcacaagtttgggagaggcgtggagtggccgctcgctctgtttggtatggctggaatgaacatcctcaatgtgggtcttgggatggatctgtttcatgcttttagaagagagagaagcaacagaagaaatcaagagaagaggaaccatgtagaatgattagccatttttttggaagccatccttagaccaaggtttattgtaaggtttataatacacattaccacactctatctgtttttttatttctgaggctttgctactatgtttctatttagctttcagattctttcctttttttttgaaggaaaactacatgtaaatgttatttgtttgatggttttttttktatgagccataagaaaatcaga

SEQ ID NO: 340 - DNA, 713 bp, Hordeum vulgare
aaagctgagctcacggtgccccttactcgcagaaaccctagcagatcgcccgagccctccgccgccgctgcgccttcagccttctcgatccaagatgaagttcattgctgcctatctgcttgcttacctctctggcaacgccagcccctctgcagaggacctgacatccattcttgagtctgttggttgtgaaattgacaatgagaagatggaactcatgctgtgccaagtgaagggcaaggacatcaccgagctcttggctgctggcagggagaagtttgctgcggttccatctggtggtggtggcgtggctgtttcagctgctgctccctctgctggaggtgctgctgcccctgcagctgagtcaaagaaagaagagaaggtcgtggagaaggaagagagcgacgatgacatgggcttcagtctgttcgactagatgcttgggtatcttgtgtctgcagtatctatctttggccaggaactagagtcaatgatgttttagcctttatttagctgagttgtgaaacgctggcaagacaatgttttgatatgtaattcagcctctggttgctggttgatttactggtgaaccatacctttgttatccaattttggtgctttaacaatgcattgttatgatatgttttgtcggctctttggcttacccttgttgtatgctagttttttggttgacaaagttaaaagttttttgg

SEQ ID NO: 341 - DNA, 606 bp, Brachypodium distachyon
agaacccttactcgcagaaaccctagaagaccactcgatctctccgccgccgccgcgccttcagctctctccctctccgatccaagatgaagttcatcgctgcctatctgcttgcttacctgtctggcaactccagcccctccgcagaggacttgacaaccattctggagtcagttggttgtgaaatcgacaatgaaaagatggaactcatgctgtcccaagtgaagggcaaggacatcgctgagctcttggctgctggcagggagaagtttgcttcagttccgtctggtggtggtggtgtagctgtggcagctgcggctcctgccagtggtggtggcggcgctgctccggcggctgagaagaaagaggagaaggtcgtggagaaggaagagagtgatgatgacatgggcttcagtctgttcgactaagtatttcgtatcttcactatcagtttttggccaggaaactagagtcgatgatgttttagcttttctttagctgagttgtgaaacactggaaagactgttttgatgtgtaactcagcacgaggttgctggtttgatttactggtgaaccgtacctttgctatccgattttgctacttta

SEQ ID NO: 342 - DNA, 588 bp, Cenchrus ciliaris
agaaaccctagagcccactcgacctcccgccgcccccgctcctctcctcactcggtctccttcccttccggatccaggatgaagtttgttgctgcctatctgcttgctgtccttgctggcaaccccagcccctctgcggaggatctttcggccattctggaatcagttggttgtgaaatcgacaatgaaaagatggaactcctgctgtcccaactgagcggtaaggacattaccgagctcattgctgctggtagggagaagtttgcttcagtcccatgtgggggtggcggtgtcgctgttgcagcagctgcccctgctgctggtggagctgctcctgcagctgaggcgaagaaggaagagaaggtcgaggagaaagaagaaagtgatgatgacatgggcttcagcctcttcgactgagcatgtgcggccatcaaagtcgtctttttgggtggaaaaatagtcctgatgtttgttttatgttggtggaaagactgctatgtagtaattcagccatagattgctatgctggttgatgtttactggtgaactaagtttttctatcaaatatattatgaattggttacctca

SEQ ID NO: 343 - DNA, 674 bp, Festuca arundinacea
ggcacgagggatcacccgagctccacgccgccgccgcccccgccccagcgcccccagctctctccctcgccgatccaagatgaagtacatcgctgcctacctgcttgcctacctgggtggcaactcctgcccctctgcagaggacctgacctccaccctggagtcagttggttgtgaaatcgacgctgagaggctggaactcttgctgtcccaagtgaagggcaaggacatcactgagctcttggctgctggtagggagaagttcgcttcggttccaagcggtggtggtggtgttgctgttgcagcagctgctcccaccagtggcggtgctgctcctgcagctgagtccaagaaggaagagaaggtcgttgagaaagaagagagtgatgatgacatgggtttcagcctgttcgactaagtggtgggcatcttctatcttcagcatcgacatttggccaagacactagagtctatgttgttttagtctttgtttagctgagttgtgaaacactgggaagactgttttgatatgtaattcagccctaggttgctggttgatttactggtgaacctaccattttgctatccaaatttcgtgctttctcagctatctactgtttctgctaaaatcaactttttaaatgctttcttattgctttattgtgttgcttgcg

SEQ ID NO: 344 - DNA, 468 bp, Leymus cinereus x Leymus triticoides
gcacgaggcagaaaccctagcagatcgctcgagctctccgccgccgccgcgccttcagctctctccttctccgatccaagatgaagttcattgctgcctatctgcttgcttacctctctggcaacgccagcccctctgcggaggacctgacatccattcttgagtcagttggctgtgaaatcgacaatgagaagatggaactcatgctgtcccaagtgaagggcaaggacatcaccgagctcttggctgctggcagggagaagtttgctgcggttccatctggtggtggtggtgtggctgtttcagctgctgctcctgctgctggaggtgctgctgcccctgcagctgagtcaaagaaagaagagaaggtcgtggagaaggaagagagtgatgatgacatgggcttcagtctgttcgactaagtggtggggcatcttgtgtctcgagtatctatccttggccaggaaa

SEQ ID NO: 345 - DNA, 541 bp, Eragrostis curvula
ctaaagacgctcgagctcaacgccgccgccgcttctcctcgggttctctccctcccggatccaggatgaagtttgttgctgcctacctgctcgccgtccttgctggcaaccccagcccctctgctgaggatttgacggccattctggagtcagttggctgtgaaatcgacaatgaaaagatggagctcctgctgtcccagctgagtggcaaggacattaccgagctcattgctgctggcagggagaagtttgcttcagtcccgtgtggtggtggtggtgtggctgttgcagcagctgcccctgctgctgctggtggtgctcctgcagctgaggcgaagaaagaggagaaggtggagaaggaagagagtgatgatgacatgggcttcagcctcttcgattaagttctgcagtcattggagtcatcttccggcaggaaaactgaagttataaatctgcattttaaccttgttttagaaattggaaagcacttgaaagacatgtactcttggtatgtagtaatgcagccgtaggtggttatgct

SEQ ID NO: 346 - DNA, 544 bp, Eragrostis curvula
agctcttcgccgccgcgccgctcctcctcgggctctcttcccccccggatcaggatgaagttgttgctgcctacctgcttgctgtcctcgctggcaaccccaacccctctgcggaggatttgacgggcattctggagtcagttggctgtgaaattgacaatgaaaagatggagctcctgctgtcccagctgagtggtaaggacatcaccgagctcattgctgcgggtagggagaagtttgcttcagtcccatgtggtggtggtagtgtggctgttgcggcggctgcccctgctgctggtggtggtgctcctgcagctgaggcgaagaaagaggagaaggtggaggagaaggaagagagtgatgatgacatgggcttcagcctcttcgactaggttctgcaatcaccgaagtcaagtctttgggctggaaaactggagttattatctgtattttaaccttgtattagaagtggggaagtactggaaagacttggtactgtcttggtgtgtagcaattcagcaataggttatgctggtaggtttac

SEQ ID NO: 347 - DNA, 657 bp, Eragrostis curvula
  misc_feature (1)..(1): n is a, c, g, or t
nttggcgcgccgcgcgaaacctagagacagtcgagctctccgccgcctctgctcgttctcgggctctctccccctccggatccaggatgaagttcgttgctgcctacctgcttgctgtccttgctggcaacaacaacccctctgcggaggatttgtcggccattctagagtcagttggctgtgaaatcgacaatgaaaagatggagctcctgctgtcccagctgagtggcaaggacattactgagcttattgctgctggtagggagaagtttgcttcagtcccaagcggcggcggtggtgtggctgttgcggcagctgccccttctgctggtggtgctgctcctgcagctgaggcgaagaaagaggagaaggtggaggagaaggaagagagtgatgatgacatgggcttcagcctcttcgactaagttctgcagtcatcagagtctagtctttggtcaggaaaactggagttcttgtatccattttaaccttgttttaggagttggaaagcactggaaaggcttgctgtcttggtgtgtcgtaaatcagccttaggttttgctggtttgtttaccgaaccaaaattttgttatcctgtttcaatgctttattaagaattggttacctgatgccaaaatcattgctgtttaaatgcta

SEQ ID NO: 348 - DNA, 727 bp, Zea mays
agtgaaggcaatatgccccactgaagcccagaagctacctaaacttccagccgtctcctccgcacgcgaaaaccctagcagctccgtagtccctctcctctggaggtattcgcagtcgaccgtgtcctcggagcacgatgaaggttgttgctgcctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcgggcagagagaagtttgcttcagtcccatgtggcggcggcggtgtggctgttgcggcaggtgcacctgctgctggcggagctgctcctgcagctgaggcaaagaaagaagagaaggtggaagagaaggaagaaagcgatgatgatatgggcttcagcctcttcgactaggttgcacagtcatcacagtattgtttcgggcagtgaaatcaaagggaaaccagagtcatgtttagattttaaccttattttatgttggaaagtactgcaaagactgctaattgtctctgtatttggtaattcagctgtagattgctatgatggttgggatttactcgtgaaccagagtttttctatcttatatcctgaattggttatcccaaagttttctggctttttaactattttgttgttacatgttg

SEQ ID NO: 349 - DNA, 790 bp, Zea mays
atatatgtgcacactgcgaagcaatcctaaccgccaccagcatccgcctctcttctcagtgccagccgccgtgcgctcgctctctctgtccctcaaggccttcgccggcgaagagcgcctagtcacccaccaggatgaagtttgttgctgcttacctgcttgctgtccttgctgggaactccagcccctctgctgaggacttgacggccattctggagtcagttggctgtgaagttgacaatgaaaagatggagctcctgctgtcccaactgagcggtaaggacattaccgagctcattgctgcgggcagggagaagtttgcttcagtcccatgcggcggcggcggcggtatggctgtggcagcagctggccctgctgctggcggagctgctcctgcagctgaggcgaagaaagaagagaaggtggaggagaaggaagagagcgacgatgacatgggcttcagcctcttcgactgagctgtgtgggcagtcatcacatcagagtagtttgttttgttttgacttttgagtcgtggaaccagaggaaaatcgtagtcgttgtttggactttaacctcgttttatgttggaaactagtttgaaaggctcctactgtctttatatttggtaattcagccgtaggtcgacattgcctccagagatgttatgaattggtcaggtttcctggctgctcactgttatgttgttacatgtcgacatcgcctcgttcatccttgcgtacgtgcgtggtaccatcgaatctgttgatagtgaataagtttggtttagctt

SEQ ID NO: 350 - DNA, 1443 bp, Zea mays
acctaaactcccagccgtctcctccgcatgcgaaaaccctagcagctccgcagtccctctcctctcgaggtggcggcgctccctcctgttttcctcttcttcttcctgtactatatagcctcccctcgcaaatcgtcactgacgagtgatgtcattccgcttgcttgattgttccagatattcgcagttgaccgggtcctcggagcacgatgaagtttgttgctgcctacttgcttgctgtcctcgctgggaacgccagcccctccgctgaggatttgactgccattctggagtcagttggctgtgaagttgacaatgaaaggatggaactcctgctgtcccaactgagcggtaaggacatcaccgagctcattgccgcgggcagggagaagtttgcttcagtcccatgtggtggcggtggtgtcgctgttgcggcagcttcacctgctgctggcggagctgctcctacagctgaggcaaagaaagaagagaaggtggaagagaaggaagaaagcgatgatgatatgggcttcagcctcttcgactaggctgcacagtcatcacagtattgtttcgggcagtgaaaccagaggaaaaccagagtcatgtttagattttaaccttgttttatgttggaaagtactgctacttgtctttatatttggtaattcagccgtaggttgctatgctggttgggatttactcgtgaaccagagtttttctatcttatatcctgaatttgttatcccaaagtttcctggctttttaactattttgttgttacatgttgatattgctttgttcatccttattcacctactatagctatttgcaatcacaaaatcacttgatggcggtgagcctagagttatcaagctgatattaatgcttcatactaggtcggccgtggcatacctcgccacgtcctcgtccaggagcgcgcctacctcctccgttcacggatctggatctgaaggaggccaaggagctcgtagagaaggcgtccgccgtgttgaaggatggagttgaaggatggagtttggaaggaagtggtagagagtattgccgagaagatgtgggcggtcggcacgagattgttctcgagtgagacgatgagagaaattccatgggagggaggagcttcatgggcgacgctacgcacaagctggggccggacggtgggcgtttagctggaggtgatggagcatctggaaacttctcgttgcgtagcggattggagagctgcacgggaccgtcgaagcgcgatcgaacggctgcaagcgcgatcgaacggctgcacaaccaaaggatgacgtggcttactgaggagcgagctttgtgtacgcgtttgttatatagaaatgtgttttatattttatttttatacatatattccaaattttaagacttggctgccaaaatattaatatccatttaatttcc

SEQ ID NO: 351 - DNA, 943 bp, Zea mays
tcattccgcttgcttgattgttccaggtattagcagtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgctcctgcagctgaggcaaagaaagaagagaaggtggaagagaaggaagaaagcgatgatgatatgggcttcagcctcttcgactaggctgcacagtcatcacagtattgttttgggcagtgaaaccagaggaaaaccagagtcatgtttagattttaagcttgttttatgttggaaagtactggaaagactgctacttgtctttatatttggtaattcaggcgaaccgcaagcaacgcaaaacgtcggccgaccggcggcggtgtttgtacagctcatgtgtgtggtggtggtgcagctcgacgacgacgacggcttcctgctttgtttttgttcttccaacctttatgcacagcaaagagctgatccctagcttagtgcttctgatctatatatgatgtgtatacacaaaacaactctgctgtttcggatccccccacccccaacttgggcagcgctcttttgttacggacttacggtcgccttttgtgatttctctcgcagccatatatagtgctgcataatttgctccgttttggcatgcaccacgtcgtggctactccttcaaaacgttgaaggacgggtaaaatctcattttaacttatatcgttttcgtatttacgaaaagggttt

SEQ ID NO: 352 - DNA, 612 bp, Zea mays
cccttactcgcagaaaccctagcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggctgtttcagctgctgcccctgctgctggaggtgctgctgcccctgcagctgagtcaaagaaagaagagaaggtcgtggagaaggaagagagtgatgatgacatgggcttcagtctgttcgactaagttgtggggcaccttgtgtctgaagtatctatccttggccaggaaactagagtcaatgatgttttagcctttatttagctgagttgtgaaacactggcaagacaatgttttgatatgtaattcagcccctggttgctggttgatttactggtgaaccatacctttgctatccaataatggtcct

SEQ ID NO: 353 - DNA, 786 bp, Zea mays
gagtgatgtcattccgcttgcttgattgttccagatattcgcagttgaccgggtcctcggagcacgatgaagtttgttgctgcctacttgcttgctgtcctcgctgggaacgccagcccctccgctgaggatttgactgccattctggagtcagttggctgtgaagttgacaatgaaaggatggaactcctgctgtcccaactgagcggtaaggacatcaccgagctcattgccgcgggcagggagaagtttgcttcagtcccatgtggtggcggtggtgtcgctgttgcggcagcttcacctgctgctggcggastgctcctacagctgaggcaaagaaagaagagaaggtggaagagaaggaagaaagcgatgatgatatgggcttcagcctcttcgactaggctggatggggccgtccagcgtcccggccatcaacggcaacagcctcacggggctcttcttctccagcatcggccaggagctggcccacttccccacgcccccgcccgtcacctcccagttctggctgtggctagtgacgtggcacctgggcctgttcatcgtgctcaccttcggccagatcggattcaagggcaggaccgaggactacttcgagaagtgaagcggttaagatcctatccatcatccctggtgctgcgctgcattgcgttgcgtgcgtgctcgccgcaatcgaacctttgctgtatagggttccgatttcgtcgaatgtaatgtatgatgctacttttgagcttcaatgtaaaatctagccgtccggccccg

SEQ ID NO: 354 - DNA, 689 bp, Zea mays
aaactcccagccgtctcctccgcacgcgaaaaccctagcagttcggtagtccctctcctctcgaggtattagcagtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgctcctgcagctgaggcaaagaaagaagagaaggtggaagagaaggaagaaagcgatgatgatatgggcttcagcctcttcgactaggctgcacagtcatcacagtattgttttgggcagtgaaaccagaggaaaaccagagtcatgtttagattttaagcttgttttatgttggaaagtactggaaagactgctacttgtctttatatttggtaattcagccgtagattgctatgctggttgggatttactcgtgaaccagagtttttctgtcttatatatcctgaattggttatcccaaagtttcttggctttttaactattttgttgttacatgtta

SEQ ID NO: 355 - DNA, 670 bp, Pennisetum glaucum
  misc_feature (669)..(669): n is a, c, g, or t
cggcacgaggtcctctcgaactccctaccgccgccgccgcgtcgctactcctcgggctctcactttccacaatccaggatgaagttcgtagctgcctatctgcttgctgtccttgctggcaacaacagcccctctgcggaggatctgacaactattctggagtcagttggtgctgaggttgacaatgaaaagatggagctcctgctgtcgcaactgagtggcaaggacatcacagagctcattgctgctggtagggagaagtttgcttcagtcccatgcggtggtggtggtgttgctgttgcggctgctgctcctgcatctggtggtggtgctcctgcagctgaggctaagaaggaagagaaggtggaggagaaggaagagagtgatgatgacatgggcttcagcctgttcgactgagtgctgagatcatctcttctatcattagtgctaagtctttgggcagagggaacgtcagggtgcttggcttttaaccttgtttaggagtttggagacactggagagactatgctactctgtctatgaaactttggtttggtttacccgtgaacccaagttttgctaccctatcttgctctttcggtaagaattgagttatctcagtgaagtttcctgggtgttccccaaaaaaaaaaacaacaacaacacaanc

SEQ ID NO: 356 - DNA, 628 bp, Pseudoroegneria spicata
cgcagaaaccctagcggatcgctcgagccctccgccgccgccgcgccttcagctctctccttccttctccgatccaagatgaagttcattgctgcctatctgcttgcttacctctctggcaacgccagcccttctgcagaggacctgacatccattcttgagtcagttggttgtgaaatcgacaatgagaagatggaactcatgctgtcccaagtgaagggcaaggacatcactgagctcttggctgctggtagggagaagtttgctgcggttccatctggtggtggtggtgtggctgtttcagctgctgctcctgctgctggaggtgctgctgcccctgcagctgagtcaaagaaagaagagaaggtcgtggagaaggaagagagtgatgatgacatgggcttcagtctgttcgactaagtcgtggggcatcttgtgtctgcagtatctatccttggccaggaaactagagtcaatgatgttttagcctttatttagctgagttgtgaaacgctggcaagacaatgttttgatatgtaacattcagcccctggttgctggttgatttactggtgaaccatacctttgctatccaattttggtgctttaacaatgcattgttttgata

SEQ ID NO: 357 - DNA, 722 bp, Oryza sativa
ctcctggaaaccctagcgagaagcactagagccgggacctcgccgccgtcaccttctccccgcacactcttcggctcccggatccacaccgccccccgccgtcgtccaaaatgaagttcatttctgcctatctccttgccactcttgctggtaaccctaacccatctgcggaggatcttacaactattctggagtcagttggagctgaagttgaccatggcaagatggagttactcttgtctcaactggctggtaaggatatcactgagattattgcttccggtcgggagaagtttgcttctgttccatgtggcggaggtggcgtagctgttgcagcagctgctccggctgctggtggtggagctgctcctcaatctgaggctaagaaagaagagaaggtggaggagaaagaagaatctgatgatgacatgggcttcagtttgtttgactaggaccattccttggattatacccatttttggttaacttgggaaacggcaacctaaacacgctttttgaattactccattttgttctataacaattcagatgcaggatattgcactgatgactatctgtcgaaccatagatttgttagaaggtttcattaccaatgatttgtttcagcaaaatcagcaccgaccatgatatgttgagtttatatgcttccctcgctgctctttactactgaagaattcacgtttttagttgccatgtttagc

SEQ ID NO: 358 - DNA, 815 bp, Sorghum bicolor
ctagcagctcggcagtcccccgctcgaggtattccattcgcagtcgaccgggtcctcggagcgccggagatcacgatgaagttcattgctgcctacctgcttgctgttcttgctggtaactccagcccctcagctgaggacttgacagccattctggagtcagttggctgtgaagttgacaatgaaaggatggaactcctgctgtcccaactgagcggtaaggacattaccgagctcattgctgcgggcagggagaagtttgcttcagtcccatgtggcggtggcggtgtagctgttgcggcagctgcccctgctgctggtggagctgctcctgcagctgaggcgaagaaagaagagaaggtggaagagaaggaagaaagtgatgatgacatgggcttcagcctcttcgactaagctgcgcagtcatagagtattattttgggcagtggtaccagacgaaaaccagagtcatgtttagattttaaccttgttttgtgtggaaattactggaaagacagctactgtcttcatattttgtattcagccgtagattgctatgctggttggggtttactggtgaaccaaagtttctctatcttatgaattggttacctcagtttcctggctgtttaactgttttgttgttacatgtcgatattgcctcgttcatcgttatccacctagtttataggtatttgcaaccatggaagcatttgatagcagtcagccaatttcatcgaatctggaattgttgatatcaatgcttggattggagtttttccataatttctaaggaatgagactcctttgttttg

SEQ ID NO: 359 - DNA, 814 bp, Sorghum bicolor
cagcctccgcctctcctcccagtgcccgccgccgtgcgcttgctctccctctccctcaaggacttcgccggcgaagagagcctagtcgcctagcaggatgaagtttattgctgcctacctgcttgctgtcctcggtgggaacctcagcccctctgctgaggacttggcagccattctggagtcagttggctgtgaagttgacaatgaaaagatggaactcctgttgtcccaactgagcggtaaggacattaccgagctcattgctgcaggcagggagaagtttgcttcagtcccatgtggcggtggcggcgtggctgtcgcggcagctgcgcctgctgctggcggagctgctcctgcagctgaggcgaagaaagaagagaaggtggaagagaaggaagaaagtgatgatgacatgggcttcagcctcttcgattaagctgtgttgtcatcagagtattcttttgagtcgtggaaccagaggaaaatcatagtcatgtttggagactttaaccttgttttatgttggaaagtacttgaaagactcctgtctttttatgtggtaattcagctgtaggttgctatgctggttggggtttccaggtgaaccagagtttttctatcctatattatgaatcggttaccagaagtttcttgattgttcaatatttgttggtacatgtcgattgagtgagtacacgtatgtgctaccatgaagctcttggtagcagtcgccaatttcattgtgcttggaattgtgaccatcattggtaactacacggaggctggccgtgggtatttatgcttttggcatgac

SEQ ID NO: 360 - DNA, 595 bp, Sorghum bicolor
ccgccgccgccgccgccgccgtgccgctacttctcagctggtagttccttccacgatccaggatgaagtttgttgctgcctatctgctggctgtcctcgctggcaacaatgacccctctgtggaggatctaaaaacaattctggagtcagttggtgctgagactgacagtgagaagatggaacacctgctgtcccaagtgagtggcaaggacatcactgagctcattgctgccggtagggagaagtttgcttctgtcccatgcggtggtggtggtgttgctgttgcagcagctgcccctgctgctgctggtggtgctgctcctgcagctgagaagaaggaagagaaggtggaagagaaggaagagagtgatgatgacatgggcttcagcctgttcgactaagtggtgtgacattgttatcatcagggcagaggaaaccagtcatgatgtcagaatgttaatgttaaccttgtaggagactgatacttagtgtcagtgttggatgttatgctggttggtttgcagctgaaccaaagttttgctaccctatctcaatgttttattatgaattgagtaccttgcctaagcaatgagca

SEQ ID NO: 361 - DNA, 898 bp, Saccharum officinarum
gcgcgcgaaaaccctagcagctcggcagtccgtcccctcgaggttttcgcagtcgaccgggtcctcggagcgcgggagaatcacgatgaagttcgttgctgcctacctgcttgctgtcctcgctgggaactccagcccctcagccgaggacttgacagccattctggagtcagttggctgtgaagttgacaatgaaaggatggaactcctgctgtcccaactgagtggcaaggacattactgagctcattgccgctggcagggagaagttcgcttcagtcccatgtggcggcggcggtgtagctgtcgcggcagccgcccctgctgctggcggagctgctcctgcagctgaggcgaagaaagaagagaaggtggaagagaaggaagaaagtgatgatgacatgggtttcagcctctttgactaagctgcgcagtcatcagagtattgttttgggcagtggaaccagacgaaaaccagagtcatgtttagattttaaccttgttttatgtggaatcactggaaagacagcgactgtcttcatattttgtattcagccgtagattgctatgctggggtttactggtgaaccaaagtttttctatcctatgaattggttacctcaagtttcctggctgtttttaaacaaaaataaaaaaaaaagggcttgcctcttctataggattccaagtttccttccgcctccttgtcaactctaaacttttttattggtggccccatcattccattattggtccgtcgttttcaacccatcataatgtgaaaacccctctctgttctcccctttatttctttgtcgcccattattcctttttcctcctcttgcgttctatctccaatggctccccacccttagttacttctctccctctttctctat

SEQ ID NO: 362 - DNA, 677 bp, Saccharum officinarum
cctccgcctctcctcccagtgccagccgccgtgcgctcgctcttgctctccctcgtggccttcgccggcgaagagcgcccagtcgcctaccaggatgaagtttattgctgcctacctgcttgctgtcctcggtgggaacctcagcccctctgccgaggacttggcagccattctggagtcagttggctgtgaagttgacaatgaaaagatggaactccttctgtcccaactgagcggtaaggacattaccgagctcattgccgcaggcagggagaagtttgcttcagtcccctgtggcggtggcggtgtggctgtcgcggcagctgcccctgctgctggcggagctgctcctgcagctgaggcgaagaaagaagagaaggtggaagagaaggaagaaagtgatgatgacatgggcttcagcctcttcgattaagctatgcagtcatcagagtattgtttttgagtcgtggaaccagaggaaagtcatagtcatgtttggagactttaataaccttgttttatgttggaaagtacttgaaagactcctgtctttatatgtggcaattcagccgtaggttgctatgctggttggggtttactggtgaaccagagtttttcaatcctgtattatgaattggttaccacaagtttcctggctgttcactattctgttggta

SEQ ID NO: 363 - DNA, 668 bp, Saccharum officinarum
cctctcctcccagtgcccgccgccgtgcgctcgctctccctctccctcgaggccttcgccggcgaagagagcgcagtcgcctaccaggatgaagtttattgctgcctacctgcttgctgtcctcggtgggaacctcagcccctctgccgaggacttggcagccattctggagtcagttggctgtgaagttgacaatgaaaagatggaactccttctgtcccaattgagcggtaaggacattaccgagcttattgccgcaggcagggagaaatttgcttcagtcccctgtggcggtggcggtgtggctgtcgcggcagctgcccctgctgctggcggagctgctcctgcagctgaggcgaagaaagaagagaaggtggaagagaaggaagaaagtgatgatgacatgggcttcagcctcttcgattaagctatgcagtcattagagtattgtttttgagtcgtggaaccagaggaaagtcatagtcatgtttggagactttaaccttgttttatgttggaaagtacttgaaagactcatgtctttatatgtggcaattcagccgtaggttgctatgctggttggggtttactggtgaaccagagtttttcaatcctgtattatgaattggttaccacaagtttcctggctgttcactgttctgttggta

SEQ ID NO: 364 - DNA, 1008 bp, Saccharum officinarum
cagaaaccctccgccgccgccgcaccgctacttttcggccctccgccgccgccgcgccgctacttctcggctcgttcattccacgatccaagatgaagtttgttgctgcctatctgcttgctgtcctcgctggcaacaatgacccctctgtggaggatctgaaaactattctggagtcagttggtgccgagattgacactgagaagatggaacacctgctgtcccaagtgagtggcaaggacatcactgagctcattgctgccggtagggagaagtttgcttctgtcccttgtggtggtggtggtggtgttgctgttgcagcagctgcgcctactgctggtggtgctgctcctgcagctgagaagaaggaagagaaggtggaagagaaggaagagagtgatgatgacatgggcttcagcctgttcgactaagtgctgtgacatatcgttatcatcagggcagaggaaaccagtcatgatgtctgaattttaaccttgtaggagactatgatacttagtatgtcagtgttggatgctatgctggttggtttgctgctgtaccaaagcagttttgctaccctatctcagatgttttattatgaattgagtaccttgcctcagcaatgagcaatgtttcatggttattcctgttcgttttccaccaacacaaaccccacagtcgaacactacacaaacaccacccaacgcataccaccccgagcacctagctccagctaagctccactaacatccagattccacggggcgggcggccctaaaagaccaaacctagctcgcggtctggcaataataactcttctttggggcccccaaaacacaacccaggccccggtatacacttcacaaacgggaacaccccgggtgtccccaacttattgcctcggaatcaacacccccttaccaaactgggttaataacacaaaaggcccccgtccattcccctccccaattctgagccaccagatgggaaacggcgcccgccctctat

SEQ ID NO: 365 - DNA, 674 bp, Panicum virgatum
gatccgccgccgcgcagaaaccctagcctccgccccccgccgccgccagtcatccccttcctcctcgggctcgctctccctccctcgtcgatccaggatgaagtttgttgctgcctatctgcttgctgtcctcgctggcaaccccagcccctctgcggaggatttgtcggccatcctggagtccgttggctgtgaaattgacaatgaaaagatggagctcctgctgtcccaactgagtgggaaggacattactgagctcatcgctgcaggcagggagaagtttgcttccgtcccatgcggcggcggtggtgtggctgtcgcagcagctgccccagctgctggtggagctgctcctgcggctgaggcgaagaaggaagagaaggtggaggagaaggaagaaagcgatgatgacatgggcttcagcctcttcgactaggctcgtgcagttatcagagttgtcttttggtcagaaaaaatcaagagtcatgatgtttggatttcaaccatgttttattttgctaatcaccggaacaactgttgctgtcttgaatcttgatatgtagtaattcagatgtaggttactatgctggttggggtttactgctgaaccagagttttccctatcctatatatcagatgaatgaattggttgcccaaaagtttctttgctgttc

SEQ ID NO: 366 - DNA, 658 bp, Panicum virgatum
gcagaaaccctagacaccgctcgagccgttcgccgctcgagccgttcgccgccgcgccgctcgtcttctcgggctctctccctcccggatccaggatgaagtttgttgctgcctatctgcttgctgtcctcgctggcaaccccagcccctctgctgaggatctatcgtccattctggaatcagttggctgtgaaattgacaatgaaaagatggagctgctgctgtcccaactgagcggcaaagacattaccgagctcattgctgctggcagggagaagtttgcttcagtcccatgcggtggtggtggtgtggctgtggcagcagctgcccctgctgctggtggagctgctcctgcagctgaggccaagaaagaagagaaggtggaggagaaggaagagagtgatgatgatatgggcttcagcctcttcgactaagctgtgcggtcaccagagttgtgtcttttcggcaggaaaaccagagtcgccatgtttggagtttaaccttgttttatgttgcaaagcacccgaaaagactgctacagtctggatatgtagtgattcagccataggttgctacactggttgttggtgtttactggtgaaccagagtttatgcatcatatattaagaatcagttacctagttcgttgatgttctct

SEQ ID NO: 367 - DNA, 667 bp, Panicum virgatum
ccgccgacttgcagaaaccctagagaccgctcgaggccgccgccgccgccgctccgctccgctcttcttctccggctccctccctcccggatcaaggatgaagtttgttgctgcctatctgcttgctgtcctcgctggcaaccccagcccctctgcaaaggatctatcgtctattctggaatcagttggctgtgaaattgacaatgaaaagatggagctgctgctgtcccaactgagtggcaaggacattaccgagctcattgctgccggcagggagaagtttgcttcggttccatgcggtggtggtggtgtggctgtggcagcagctgcccctgctgctggtggagctgctcctgcagctgaggccaagaaagaagagaaggtcgaggagaaggaagagagtgatgatgacatgggcttcagcctcttcgactaagctgtgtggtcatcagagttgtctttttggcaggaaaaccagagtcgccatgttttgacttttactttgttttatgttgcgaagcacctgaaaagattgctactgccttgatatgtagtatttcagccgtaggttgctaggctggttggtgtttactggtgaaccagagtttatgcatcatatattgagaatcggttacccaattcattgctgttctctactgtgttgctc

SEQ ID NO: 368 - DNA, 651 bp, Panicum virgatum
gccttgcagaaaccctacagaccgctcgaggccgccgccgccgctccgctctgctcttcttctccggctccctccctcccggatcaaggatgaagtttgttgctgcctatctgcttgctgtcctcgctggcaaccccagcccgtctgccgaggatctatcgtccattctggaatcagttggctgtgaaattgacaatgaaaagatggagctgctgctgtcccaactgagcggcaaggacattaccgagctcattgctgccggcagggagaagtttgcttcggtcccatgcggtggtggtggagtggctgtggcagcagctgcccctgctgctggtggagctgctcctgcagctgaggccaagaaagaagagaaggtggaggagaaggaagagagtgatgatgacatgggcttcagcctcttcgactaagctgtgtggtcatcagagttgtgtcttttcggcaggaaaaccagagtcgccatgtttggattttaactttgttttatgctgcaaagcacctgaaaagattgctactgccttgatatgtagtatttcagccgtaggttgctaggctggttggtgtttactggtgaaccagagtttatgcatcatatattgagaatcggttacccaattcattgctgttctctac

SEQ ID NO: 369 - DNA, 593 bp, Panicum virgatum
ctctccctcccggatccaggatgaagtttgtcgctgcctatctgcttgctgtcctcgctggcaaccccagcccctccgcggaggatttgtcggccattctggagtcagttggctgtgaaattgacaatgaaaagatggagctcctgctgtcccaactgagtggaaaggatattactgagctcattgctgcgggcagggagaagtttgcttcggtcccatgcggtggtggtggtggtggtgtggctgttgcggcagctgccccagctgctggtggagctgctcctgcagctgaggcgaagaaggaagagaaggtggaggagaaggaagagagtgatgatgacatgggcttcagcctcttcgactaggcttgtgcagtcatcagagttttgtttttttggcaggaagaccaagatgtttggatttcaaccttattttgttttgcaaatcaccggaaagactgttgctatcttgatatgtagtaattcagctgtagcctgtaggttgctctgctggttggggtttactggtgaaccagagttttccctatcctatatatcagatgaattggtttcccaaaaagttttttttcctct

SEQ ID NO: 370 - DNA, 646 bp, Panicum virgatum
ctcgcacatttaaccctagagaccgctcgagccgtcctccgccgccgctcccgctcccgctcatcttctcctcgggcgctctccctcccggatccaggatgaagtttgttgctgcatatctacttgctgtcctcgctgggaaccccagcccctctgcggaggatctgtcggccatactggaatcagttggctgtgaaatcgacagtgaaaagatggagctcctgctgtcccaactgagcggcaaggacattacggagctcattgctgctggcagggagaagttcgcttcagtcccctgcggtggtggtggtgtggctgtcgcggccgctgcaccagctgctggtggcgctgctcctgcagctgaggcgaagaaggaagagaaggtggaggagaaggaagaaagcgatgatgacatgggcttcagcctcttcgactaggcttctgcagtcatcagagctgtctcatttgagtaggaaaaccaagagtcgatgtttggatttgaaccctgttttattttgccaatcaccagaaagacttattatcttgatatgtagtaattcagctgtaggttgctatgctggttgtggtatgcttgtgaaccagagttttcactatcctatatatatccgatgaattggttgcccaa

SEQ ID NO: 371 - DNA, 658 bp, Panicum virgatum
ggcctcgcacatttaaccctagagaccgctcgagccgtcctccgccgccgctcccgctcatcttctcctcgggcgctctccctcccggatccaggatgaagtttgttgctgcatatctacttgctgtcctcgctgggaaccccagcccctctgcggaggatctgtcggccatactggaatcagttggctgtgaaatcgacagtgaaaagatggagctcctgctgtcccaactgagcggcaaggacattacggagctcattgctgctggcagggagaagttcgcttcagtcccctgcggtggtggtggtgtggctgtcgcggccgctgcaccagctgctggkggcgctgctcctgcagctgaggcgaagaaggaagagaaggtggaggagaaagaagaaagtgatgatgacatgggcttcagcctyttcgactaagctgtgtggtcatcagagttgtgtctttttggcaggaaaaccagagtcgccatgtttggattttaactttgttttatgctgcaaagcmcctgaaaagattgctactgccttgatatgtagtatttcagccgtaggttgctaggctggttggtgtttactggtgaaccagagtttatgcatcatatatygagaatcggttacccaattcattgctgttctctaga

SEQ ID NO: 372 - DNA, 807 bp, Triticum aestivum
gtttcggttctcgagtcatcgctgtctggaacagcccttactcgcagaaaccctagcagatcgctcgagccctccgccgccgccgcgccttcagctctctccttccttcaccgattcaagatgaagttcatcgctgcctatctgcttgcttacctctctggcaacgccagcccctctgcagaggacctgacatccattcttgagtcagttggttgtgaaatcgacaatgagaagatggaactcatgctgtcccaagtgaagggcaaggacatcactgagctcttggctgctggtagggagaagtttgctgcggtaccatctggtggtggtggtgtggctgtttcagccgctgctcctgctgctggtggtgctgctgcccctgcagctgagtcaaagaaagaagagaaggtcgtggagaaggaagagagtgatgatgacatgggcttcagtctgttcgactaagtcgtggggcatcttgtgtctgcagtatctatccttggccaggaaactagagtcaatgatgttttagcctttatttagctgagttgtgaaacgctggcaagacaatgttttgatatgtaattcagcccctggttgctggttgatttactggtgaaccatacctttgctatccaattttggtgctttaacaatgcattgttttgatatgttctgcctgttccatgtatcctctatggcttccccattttcttaagtatttggtcgacctaattcagatttctttgtaaatcggcacatccttgagtgttaagtgccatggtcgttacagcaaagcaaatctcattc

SEQ ID NO: 373 - DNA, 781 bp, Triticum aestivum
tcatcgctgtctggaacagcgatgactcgcagaaaccctagcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggctgtttcagctgctgcccctgctgctggaggtgctgctgcccctgcagctgagtcaaagaaagaagagaaggtcgtggagaaggaagagagtgatgatgacatgggcttcagtctgttcgactaagttgtggggcaccttgtgtctgaagtatctatccttggccaggaaactagagtcaatgatgttttagcctttatttagctgagttgtgaaacactggcaagacaatgttttgatatgtaattcagcccctggttgctggttgatttactggtgaaccatacctttgctatccaattttggtcctttaacaatgcgttgttttgatgttctgcctgttccatgtatccttaaatcgctgtcccatttttctgctagtgttttggtgaacctaatacagaattctttgtaaattggcacatcgttgagtggtaagtgccatggttgttacagcgca

SEQ ID NO: 374 - DNA, 1159 bp, Hordeum vulgare
aggcggagaggggagagggggctaggcggctagcgcgtggacgggtgcggctctcggctcgccacgacgcccrcatgccgccgccccgccgcgccggcgcgggcgacacgagcgccttcttcgcggcgacgctggtgctgtgggccgtgtcggtggggttcgagatcggcgcgcggggccgccgcgagctggccgccgtggccgccggcttcgccttcttccaggccgccaacaccgccgtccgcgccgcggtctcccgcgacccgctcttcgtcaacaccgccgtctctctgctccactcctccctcacctccgcctcagttatctttgttctgttgtgccaatggcgcaccaagggccttgagaacatgtttcagcatgaagaattagttggtagcagttggattggagcatattctgctctgtgcttttcatgtggctactttgcttatgaccaattggatatgctccgctaccggctatacagtggatggattcctgggattctgatgcatcaccttattctgctcatttgctttacgctagctctgtatcggaatgtgacaatcaactacctaattctcactcttctatgcgagatgcactccatattcttgcatgtaaggaaattgaggagaatggctggattccgcgatttcaacagaaaactggtgaaactggaatgggtactcaactggactacctttgtcacagcaagggtgatctgccacatattgatcacatacagactgatcaccgacgcacacaagtttgataagggcattgagctgccactagccctttctggtatggcaggaatgaatgtgctcaatgtatctttagggcttgacctatttaaagcgttcgcgcgagagagaaatcagcagacgcatcaggactgaatgtgtcttttcttgatagtgtaatgtatattttggcaaggttatagtcacaccagtgtaaatcagaagacagaggtatgttctaagtgttgttagcctctagactgtagtgacaatccatatatgtaatctggkatgtatgatgaattcgtattaagatgtctccggaaagaatctgtggctattccagcattagtggaatcacatcatgacctatgtgggacagaacacgcgcaaaggcagccatcccgggacgg

SEQ ID NO: 375 - DNA, 1273 bp, Zea mays
ccaccgtgccggaggaggcgcagcggcggcggacacgaagcgcgtttcgcggcggacgtaggtactttggctgtgtccttggggttcgagaatcgccgtgcggggaagacgcgagctggcgcccgtggccgccggctttgcctttttccaggccgccaacaccgcagttcgcggcttggtttcccgcgatccgctttttgtcaacaccgccgtattgcttttccactcctccctcacctccgtttccgttatctttgttcttgctaatcaatggcgtaataagggccttgagaacatgtttgagcatgaagaactatttggtggcagttggattggagcatattctgctctgtgcttttcttgtggctactttgcatatgaccaactggacatgctccgataccggctatacagtggatggcttcctggaattctcatgcatcacttgatcctactcatttgctttacactagctctgtataggaatgtcacaatcaactacctaaatctctcccttgtatgtgagctgcactccatatttttacatgtaaggaaagtcaggcgaatggttggatttcgggattttgacagaacagtggtgaagctggaatgggtactcaactggactacctttgtaacagcaagggtgatatgccatatcttgattacttacaagctcatctctgatgcccacaaatttgggaagggcattgagcttccgctagctctacttggtatggcaggaatgaatctgcttaacatatttcttgggctcgatctacttaaagcattcacacgagaaagaaataagcagaaccatcaggattgaatgcacctttcttgatggcggtgtactctaaattttgagaaggctgtagttccgttcttgtagggacatagaggtatgtttaagtcttaattaatcagcaactacactggaggctatggattctttatgtatcaacacgtgctaatgctaagatctctacaagaaagggttgttaccagtatgtgtaatcatgtaggtataacattattgttcattaggagaattaagagagtgcaggcgggtaactggatgcaggatttacatacattttgcaatcaggaatcggaaagaagagaagcgtaccatgtatcaaaccccttggtcccaactcccatacctcatctaaagtaacacctaagcaacttgtagattggcactgtgactttgaggctacaatgctcttgtttattaatatttataatatttgacgatatcttgctgggg

SEQ ID NO: 376 - DNA, 1053 bp, Pseudoroegneria spicata
gctagcgtgtggacgggtgcggctctcggctcsccacgacgcccccatgccgccgccccgtcgcgccggcgcgggcgacacgagcgccttcttcgcggcgacgctggtgctgtgggccgtgtcggtggggttcgagatcggcgcgcggggccgccgcgagctggccgccgtggccgccggcttcgccttcttccaggccgccaacaccgccgtccgcgccgcggtctcccgcgacccgctcttcgtcaacaccgcggtctcgctgctccactcctccctcacctccgcctcagttatctttgttctattgtgccaatggcgtaccaagggcctcgagaacatgtttcagcatgaggaattagttggtagcagttggattggagcatattctgctctgtgcttttcatgtggctactttgcttatgaccaattggatatgctccgctaccggctatacagtggatggattcctgggattctgatgcatcaccttattctgcttatttgctttacgctagctctgtatcggaatgtgacaatcaactacctaattctcactcttctgtgcgagatgcactccatattcttgcacgtaaggaaattgaggagaatggctggattccgtgatttcaacagaaaactggtgaaactggaatggatactcaactggactacgtttgtgacagcaagggtgatctgccacatattgatcacatatagactgatcaccgacgcacacaagtttgataagggcattgagctgccactagctctttctggtatggcaggaatgaatgtgctcaatgtatctttagggctcgatctatttaaagcgttcgcgcgagagagaaatcagcagacgcatcaggactgaatgttcttggcagtgtactgtaaattttggtaaggttatagtcacaccaatgtaaatcagaagacagaggtatgttctaagtgttgttagcctctagactgtagtgacaacccatatatgtaatctgttatgtatgatgaattcgtgttaagatgtctcgcggaaggattctctggcya

SEQ ID NO: 377 - DNA, 1203 bp, Sorghum bicolor
ccgagccgacgacgaacccgatgccgccccaccgtgccggaggggccgcaggcggcggtgacacgagcgcgttcttcgcggcgacgctagtgctctgggctgtgtctgtggggttcgagatcggcgtgcgggggcgacgcgagcttgcgcccgtggccgccggcttcgccttcttccaggccgccaacgccgcggtccgcggctcggtctcccgcgacccgctcttcgtcaacaccgccgtatcgctcctccactcctccctcacctccgtctccgttatctttgttcttgtccatcaatggcgtaataagggctttgagaccatgtttgagcatgaagaactatttggtggcagttggattggagcatattctgctctgtgcttttcttgtggctactttgcgtatgaccaactggacatgctccgttaccggctgtacagtggatggattcctggaattctcatgcatcacttgatcctactcatttgctttacactagctctgtataggaatgtcacaatcaactacctaattctctcccttgtatgcgagctgcactccatatttttgcatgtaaggaaagtgaggcgaatggttggatttcgggatttccacagaacaatggtgaagctggaatgggtactcaactggactacctttgtgacagcaagggtgatatgccatatcttgataacttacaagctcatagctgatgcccacaaatttgggaagggcattgagcttccgctagctcttcttggtatggcaggaatgaatctgctcaacatatttctagggcttgatctactgaaagcattcacacgagaaagaaatcagcaaaaccatcaggactgaatgcacctttcttgactgtggtgtactctaaattttgagaaggccgtagttccgttcctgtagggatagagaggtatgtttaaagtcttaattagcaactacactagaggctatttatgtatgcattctttatgtataccaacacatgctaatgctaagatctctaccagaaagggttgttgccagcatgtgcatccatgtagataacattactgttcattaggagaatgcaggcgggtacctggatgcaggattttacatacattccttccctttggtcccaactcgcaaacctcatctaaagtaaaccccgaagcaacttgtggattggccctgtgaggctaca

SEQ ID NO: 378 - DNA, 1196 bp, Triticum aestivum
gaagaggggagggggggactagccggctagcgtgtggacgggtgcggctctcggctcgccacgcggagacggcacgagccccgatgccgccgccccgccgcgccggcgcgggcgacacgagcgccttcttcgcggcgacgctggtgctgtgggccgtgtcggtggggttcgagatcggcgcgcggggacgccgcgagctggccgccgtggccgccggcttcgccttcttccaggccgccaacacggccgtccgcgccgcggtctcccgcgacccgctcttcgtcaacaccgccgtctcgctgctccactcctccctcacctccgcctcagttatctttgttctattgtgccaatggcgtaccaagggccttgagaacatgtttcagcatgaagaattagttggtagcagttggattggagcatattctgctctgtgcttttcatgtggctactttgcttatgaccaattggacatgctccgctaccggctgtacagtggatggattcctgggattctgatgcatcaccttattctgcttatttgctttacgctagctctgtatcggaatgtgacaatcaactacctaattctcactcttctatgcgagatgcactccatattcttgcacgtaaggaaactgaggagaatggctggattccgcgatttcaacagaaaactggtgaaactggaatgggtactcaactggactacctttgtgacagcaagggtgatctgccacatattgatcacatacaaactgatcaccgacgcacacaagtttgataaaggcattgagctgccactagctctttctggtatggcaggaatgaatttgctcaatgtatctttagggcttgatctatttaaagcgttcgcgcgagagagaaatcagcagacgcatcaggactgaatgttcttgacagtgtactgtaaatttttgtaaggttatagtcacaccaatgtaaatcagaagacagaggtatgttctaagtgttgttagtctctagactgtagtgacaacctatatatgtaatcttatgtatgatgaatttgtattaagatgcctcgcggaaagattctctggcttttgccagcattagtggaattacatagacaacccaacctggatccagcatttgtgcagatyttttaaagcattacctctgtccgaaaaagcttgtgttagattyactgt

SEQ ID NO: 379 - protein, 534 aa, Brachypodium distachyon
MENETSDAPAAAVVAEQLPAVAEEGDGEAEAVGSTLTMERVAAAKKFIENHYRSHMKNIQERRERRVRLERQLATSEVPREQQINLIKDLERKETEYMRLKRHKICVDDFELLTIIGRGAFGEVRLCREKTSGNIYAMKKLKKSDMVIRGQVEHVRAERNLLAEVASHCIVKLYYSFQDAEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLKESMDVDRSLSETTNGRRWRSQHEQLQHWQMNRRKLAFSTVGTPDYIAPEVLLKKGYGMECDWWSLGAIMYEMLVGYPPFYSDDPITTCRKIVHWRNHVKFPEDSRLSPEARDLICRLLCDVEHRIGGAGADQIKAHPWFHGVAWDKLYEMEAAFKPQVNDELDTQNFMKFDEMDNPPARTGSGQSRKMKLNSKDLSFVGYTYKNFDAVKGLKHADMQRSSSLTRPSLGSIFGEAPREPNGKDTHMHTDSSEDPMSP

SEQ ID NO: 380 - protein, 542 aa, Zea mays
MEREMADAPAAAIPAAEPLAAVAEEGEGEAAAEAVGSTLTMERVAAAKKFIESHYRSQMKNIQERKERRFRLERQLASSQVPKEQQINLMKDLERKETEYMRLKRHKICVDDFELLTIIGRGAFGEVRLCRERTSGNIYAMKKLKKSDMVVRGQVEHVRAERNLLAEVASHHCIVKLYYSFQDTEYLYLIMEYLPGGDIMTLLMREDTLTEHAARFYVAETILAIESIHKHNYIHRDIKPDNLLLDKNGHMKLSDFGLCKPIDCSKLSTLNEDEPMSDDNLRESMDIDSSLSDTANGRRWRSQHEQLQHWQMNRRKLAFSTVGTPDYIAPEVLLKKGYGMECDWWSLGAIMYEMLIGYPPFYADDPITTCRKIVHWRNHLKFPEDAKLSNEARDLISRLLCDVDHRIGSAGADQIKAHPWFRGVAWDKLYEMEAAFKPQVNDELDTQNFMKFEELENPPAKTGSGPSRKTMLNSKDLSFVGYTYKNFDAVKAIKISDLQRNSSLTRPSIGSIFGPPGMDSPMEPNGRGTHMHTVSSGDPMIP

SEQ ID NO: 381 - protein, 548 aa, Zea mays
MESEMADAPAAAIPAAAAEPLAAVAEEGEGEAEGEAPAEAAVGSTLTMERVAAAKKFIENHYRSQMKTIQERKERRFKLERQLASSQVPKEQQIDLIKDLERKETEYMRLKRHKICVDDFELLTIIGRGAFGEVRLCREKTSGNIYAMKKLKKSDMVVRGQVEHVRAERNLLAEVASHCIVKLYYSFQDTEYLYLIMEYLPGGDIMTLLMREDTLTEHVARFYIAETILAIQSIHKHNYIHRDIKPDNLLLDKNGHMKLSDFGLCKPIDCSKLSTLNEDEPMGDDNMRESMDIDSSLSNTANGRRWRSQHEQLQHWQMNRRKLAFSTVGTPDYIAPEVLLKKGYGMECDWWSLGAIMYEMLVGYPPFYADDPITTCRKIVHWRNHLKFPEDAKLSNEARDLICRLLCDVDHRIGSAGADQIKAHPWFQGVAWDKLYEMEAAFKPQVNDELDTQNFMKFEELENPPAKTGSGPSRKMMLNSKDLSFVGYTYKNFDAVKAIKISDLQRNSSLTRPSIGSIFGPSGMDSPMEPNGRDTHMHTVSSGDPMIP

SEQ ID NO: 382 - protein, 477 aa, Sorghum bicolor
MHCRRFRLERQLASSQVPKEQQINLMKDLERKETEYIRLKRHKICVDDFELLTIIGRGAFGEVRLCREKTSGNIYAMKKLKKSDMVVRGQVEHVRAERNLLAEVASHCIVKLYYSFQDTEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSLSDTANGRRWRSQHEQLQHWQMNRRKLAFSTVGTPDYIAPEVLLKKGYGMECDWWSLGAIMYEMLVGYPPFYADDPITTCRKIVHWRNHLKFPEDAKLSNEARDLICRLLCDVDHRIGSAGADQIKAHPWFRGVAWDKLYEMEAAFKPQVNDELDTQNFMKFEELENPPAKTGSGPSRKMMLNSKDLSFVGYTYKNFDAVKAIKISDLQRNSSLTRPSIGSIFGPPGMDSPMEPNGRDTHMHTVSSGDPMIP

SEQ ID NO: 383 - protein, 501 aa, Saccharum officinarum
  misc_feature (122)..(122): Xaa can be any naturally occurring amino acid
  misc_feature (341)..(341): Xaa can be any naturally occurring amino acid
MERVAAAKKFIENHYRSQMKNIQERKERRFRLERQLASSQVPKEQQINLMKDLERKETEYMRLKRHKICVDDFELLTIIGRGAFGEVRLCREKTSGNIYAMKKLKKSDMVVRGQVEHVRAEXNLLAEVASHCIVKLYYSFQDTEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSLSDTANGRRWRSQHEQLQHWQMNRRKLAFSTVGTPDYIAPEVLLKKGYGMECDWWSLGAIMYEMLVGYPPFYADDPITTCRKIVHWRNHLKXPEDAKLSNEARDLICRLLCDVDHRIGSAGADQIKAHPWFRGVAWDKLYEMEAAFKPQVNDELDTQNFMKFEELENPPTKTGSGPSRKTMLNSKDLSFVGYTYKNFDAVKAIKISDLQRNSSLTRPSIGSIFGPPGMDSPMEPNGRDTHMHTVSSGDPMIP

SEQ ID NO: 384 - protein, 541 aa, Panicum virgatum
MESEMADAPAAIPAPAAEPLAAVAEEGEGEGAEAVGSTLTMERVAAAKKFIENHYRSQMKNIQERKERRFKLERQLASSQVPKEQQINLIKDLERKETEYMRLKRHKICVDDFELLTIIGRGAFGEVRLCREKTSGNIYAMKKLKKSDMVVRGQVEHVRAERNLLAEVASHCIVKLYYSFQDAEYLYLIMDYLPGGDIMTLLMREDTLTEHVARFYIAETILAIESIHKHNYIHRDIKPDNLLLDKNGHMKLSDFGLCKPIDCSKLSTLNEDEPMGDDNLRESMDVDSSLSDTANGRRWRSQHEQLQHWQMNRRKLAFSTVGTPDYIAPEVLLKKGYGMECDWWSLGAIMYEMLVGYPPFYADDPITTCRKIVHWRNHLKFPEDARLSNEARDLICRLLCDVDHRIGSAGADQIKAHPWFRGVAWDKLYEMEAAFKPQVNDELDTQNFMKFEELENPPARTGSGPSRKMMLNSKDLSFVGYTYKNFDAVKAIKISDLQRNSSLTRPSIGSIFGPPGMDSPMEANGRDTHMHTISSADPMIP

SEQ ID NO: 385 - protein, 538 aa, Triticum aestivum
MESEMSDAPPAAAAVAEPLAAVAEEGEGEGEASTLTMERVAAAKKFIENHYRSHMKNIQERKERRFRLERQLATSEVPREQQINLIKDLERKETEYMRLKRHKICVDDFELLTIIGRGAFGEVRLCREKTSGNIYAMKKLKKSDMVIRGQVEHVRAERNLMAEVASHCTVKLYYSFQDTEYLYLIMEYLPGGDIMTLLMREDTLTEPVARFYIAETILAIESIHKHNYIHRDIKPDNLLLDKNGHMKLSDFGLCKPIDCSKLSTLSEDEPMGDDNLKESMDVDSSLSETANGRRWRSQHEQLQHWQMNRRKLAFSTVGTPDYIAPEVLLKKGYGMECDWWSLGAIMYEMLVGYPPFYSDDPITTCRKIVHWRNHVKFPDDSRLSPEARDLICRLLCDVDHRIGGAGADQIKAHPWFRGVAWDKLYEMEAAFKPQVNDELDTQNFMKFDEMDNSPPARTGSGPSRKAKLNSKDLSFVGYTYKNFDAVKGLKHADMQRSSSLTRPSIGAIFGSNGMESSREPNGKDTHMHTFSSGDPMSP

SEQ ID NO: 386 - protein, 141 aa, Brassica rapa
MGVSLFVGFTLLSLCLPTSTSELLQFQLSTISAAPSFLPEAPSSFSASPPEATSPDISPLFPTPGSSEMSPSPSESSAMPTIPSSLSPPNPDAVARDPLLDTSPVGSPLPASSSVALVWSPLSLLLVFPMLLLLPFSRFSS

SEQ ID NO: 387 - protein, 140 aa, Brassica rapa
MTVVSLLVAFTVLSLCLHTSTSELLQFQLSTISSAAPTFLPEAPSSFSASPLEAMSPDISPLFPTPGSSETSPSPSESFDMPTIPSSLSPPNPDAVSPDPLLDSSPVGSPLPASSSVSLVSSPLSLLLVFPMLILAFCRF

SEQ ID NO: 388 - protein, 153 aa, Brassica napus
AETHSQKERKKSMGVSLFVGFTLLSLCLPTSTSELLQFQLSTISAAPSFLPEAPSSFSASPPEATSPDISPLFPTPGSSEMSPSPSESSAMPTIPSSLSPPNPDAVARDPLLDTSPVGSPLPASSSVALVWSPLSLLLVFPMLLLLPFSRFSS

SEQ ID NO: 389 - protein, 156 aa, Raphanus sativus
EPPKVSSQRLTHSQEETMTVVSLLVAFTVLSLCLHTSTSEFLEFQLSTISAAPSFLPEAPLSFSASPPLEAIMSPDISPLFPTPGSSEMSPSPSGSFDMPTIPSSLSPPNPDAVSPLDSSPVGSPLPVSSSVSLVSLTPLSLLLVFLVFMLPYCRL

SEQ ID NO: 390 - protein, 182 aa, Antirrhinum majus
MRKLKFHEKKLLKKVNFLEWKREGGQRENLVMHRYHVTGRDDYKKYSSLCRMAQKLVNILKQMDARDPYRIEMTDALLEKLYNMGVIPSRKSLKLCERLSVSSFCRRRLATILVRLKFAEHLKEAITYIEQGHIRVGPDTVTDPAFLVTRNMEDFITWVDTSKIRRKVLEYNEKLDDYDAMN

SEQ ID NO: 391 - protein, 182 aa, Malus domestica
  misc_feature (19)..(19): Xaa can be any naturally occurring amino acid
  misc_feature (24)..(24): Xaa can be any naturally occurring amino acid
MRELKFHEKKLLKKVNFLXWKREXGHRETQVLQRYHVTGRDDYKKYSGLCRMVHKLVNILKQLNPNDPYRIEMTDMLLEKLYNIGVIPSKQSLALCERLSVSSLCRRRLSTVLVRLKFAEHLKEAVTYIEQGHIRVGPETVTDPAFLVTRNMEDFITWVDSSKIRRKVLQYNDKLDDYDAMN

SEQ ID NO: 392 - protein, 182 aa, Arabidopsis thaliana
MRKLKYHEKKLIKKVNFLEWKREGNHRENEITYRYHMGSRDDYKKYSGLCRMVQKLTNIMKQMDPADPFRIQMTDMLLEKLYNMGVIPTRKSLTLTERLSVSSFCRRRLSTVLVHLKFAEHHKEAVTYIEQGHVRVGPETITDPAFLVTRNMEDFITWVDSSKIKRKVLEYNDTLDDYDMLA

SEQ ID NO: 393 - protein, 182 aa, Brassica rapa
MRKLKFHETKLIRKTNFLEWKREGGHRENLITRRYHMGGRDDYKKYSGLCRMVQKLTNVMKQMDPTDPFRVQMTDLLLEKLYNMGVIPTRKSLALTDRLSVSSFCRRRLSTVLVHLKYAEHLTEAVTYIEQGHIRVGPDTITDPAFLVTRNMEDFITWVDSSKIKRKVLQYNDKLDDYDMLA

SEQ ID NO: 394 - protein, 182 aa, Brassica rapa
  misc_feature (41)..(41): Xaa can be any naturally occurring amino acid
MRKLKNHEKKVLKKVNFLEWKREGGHRETLITGRYHMGGRXDYKKYSGLCRMVQKLTNVLKQMDATDPFRIQMTDMLLEKLYNMGVIPTRKSLALTDRLSVSSFCRRRLSTVLVHLKYAEHLTEAVTYIEQGHIRVGPDTITDPAFLVTRNMEDFITWVDSSKIKRKVLQYNDKLDDYDMLA

SEQ ID NO: 395 - protein, 182 aa, Phaseolus coccineus
MRKLKFHEKKLLKKVNFLEWKREGGHRENLVMQRYHVTGRDDYKKYSGLCHMVQKLVNILKQMDAKDPFRVDMTDKLLEKLYNMGVIPTRQSITLCERLTVSSFCRRRLSTVLVRLKFAEHLKEAVTYIEQGHIRVGPETVTDPAFLVTRNMEDFITWVDSSKIKRKVLQYNDKLDDYDLMN

SEQ ID NO: 396 - protein, 182 aa, Theobroma cacao
MRRLKFHEKKLLKKVNFLEWKREGGHRENLVMHRYHVTGRDDYKKYSSLCRMVQKLVNILKQMDPRDPFRIEMTDLLLEKLYNMGVIPTRKSLALCDRLSVSSFCRRRLSTVLVHLKFAEHLKEAVTYIEQGHIRVGPETMTNPAFLVTRNMEDFITWVDTSKIRRKVLEYNEKLDDYDAMN

SEQ ID NO: 397 - protein, 182 aa, Brassica napus
  misc_feature (5)..(5): Xaa can be any naturally occurring amino acid
  misc_feature (9)..(9): Xaa can be any naturally occurring amino acid
  misc_feature (11)..(11): Xaa can be any naturally occurring amino acid
  misc_feature (33)..(33): Xaa can be any naturally occurring amino acid
  misc_feature (35)..(35): Xaa can be any naturally occurring amino acid
  misc_feature (37)..(37): Xaa can be any naturally occurring amino acid
  misc_feature (115)..(115): Xaa can be any naturally occurring amino acid
  misc_feature (118)..(118): Xaa can be any naturally occurring amino acid
MRKLXFHEXKXIRKTNFLEWKREGGHRENLITXRXHXGGRDDYKKYSGLCRMVQKLTNVMKQMDPTDPFRIQMTDLLLEKLYNMGVIPTRKSLALTDRLSVSSFCRRRLSTVLVXLKXAEHLTEAVTYIEQGHIRVGPDTITDPAFLVTRNMEDFITWVDSSKIKRKVLQYNDKLDDYDMLA

SEQ ID NO: 398 - protein, 182 aa, Centaurea maculosa
  misc_feature (63)..(63): Xaa can be any naturally occurring amino acid
  misc_feature (70)..(70): Xaa can be any naturally occurring amino acid
  misc_feature (177)..(177): Xaa can be any naturally occurring amino acid
MRKLKFHEKKLLKKVNFLEWKREGGHREAQVMHRYHVTGRDDYKKYSGLCRMAQKLVNILKQXDPRDPYXIEMTDALLEKLYNMGVIPSQKSLALCDRLSVSSFCRRRLATLLVRLKFAEHLKEAVTYIEQGHIRVGPDTVTDPAFLVTRNMEDFVTWVDTSKIKRKVMVYNDKLDXYDAMV

SEQ ID NO: 399 - protein, 182 aa, Citrus sinensis
MRKLKFHEKKLLKKVNFLEWKREGGHREAMIMQRYHVTGRDDYKKYSSLCGMVQKLVNILKQMDPRDPFRIEMTDMLLEKLYNMGVIPSRKSLALCDHLSVSSFCRRRLATILVRLKFAEHLKEAVTYIEQGHIRVGPETVTDPAFLVTRNMEDFITWVDTSKIKRKVLEYNDKVDDYDAMN

SEQ ID NO: 400 - protein, 182 aa, Gossypium hirsutum
MRKLKFHEKKLLKKVNFLEWKREGGHRENLILHRYHVTGRDDYKKYSGLCRMVQKLVNILKQMDPRDPFRIEMTDLLLEKLYNMGVIPTRKSLALCDRLSVSSFCRRRLSTVLVHLKFAEHLKEAVTYIEQGHIRVGPETVTDPAFLVTRNMEDFITWVDTSKIRRKVLEYNEKLDDYDAMN

SEQ ID NO: 401 - protein, 182 aa, Vigna unguiculata
MRKLKFHEKKLLKKVNFLEWKREGGHRENLVMQRHHITGRDDYKKYSGLCHMVQKLVNIVKQMDAKDPFRVDMTDKLLEKLYNMGVIPTRQSITLCERLTVSSFCRRRLSTVLVRLKFAEHLKEAVTYIEQGHIRVGPETVTDPAFLVTRNMEDFITWVDSSKIKRKVLQYNDKLDDYDLMN

SEQ ID NO: 402 - protein, 182 aa, Cynara scolymus
MRKLKFHEKKLLKKVNFLEWKREGGHREAQVMHRYHVTGRDDYKKYSSLCRMAQKLVNILKQMDPRDPYRIEMTDALLEKLYNMGVIPSQKSLALCDRLSVSSFCRRRLATLLVRLKFAEHLKEAVTYIEQGHIRVGPDTVTDPAFLVTRNMEDFVTWVDTSKIKRKVMVYNDKLDDYDAMV

SEQ ID NO: 403 - protein, 174 aa, Taraxacum officinale
  misc_feature (123)..(123): Xaa can be any naturally occurring amino acid
  misc_feature (167)..(167): Xaa can be any naturally occurring amino acid
MRKLKFHEKKLLKKVNFLEWKREGGHREAQVMHRYHVTGRDDYKKYSSLCRMAQKLVNILKQMDPRDPYRIEMTDSLLEKLYNMGVIPSQKSLALCDRLSVSSFCRRRLATVLVRLKFAEHLXEAVTYIEQGHIRVGPDTVTDPAFLVTRNMEDLSRGLILRRLKEXSWSIMIS

SEQ ID NO: 404 - protein, 182 aa, Vitis vinifera
MRKLKFHEKKLLKKVNFLEWKREGGHREAHVMHRYHVTGRDDYKKYSGLCRMVQKLVNILKQMDPRDPFRIEMTDTLLEKLYNIGVIPTRKSLALCDRLAVSSFCRRRLSTVLVRLKFAEHLKEAVTYIEQGHIRVGPDTVTDPAFLVTRNLEDFVTWVDSSKIKRKVLQYNERLDDYDAMN

SEQ ID NO: 405 - protein, 183 aa, Ipomoea nil
MRKLKFHEKKLVKKANFLEWKREHGHREALVMHRYHVTGRDDYKKYSGLCRMTQKLVNILKQMDARDPFRIEMTDALLEKLYNMGVISERKSLALCDKLSVSSFCRRRLSTVLVKLKFAEHLKEAVTYIEQGHIRVGPDTITDPAFLVTRNMEDFITWVDTSKIRRKVLEYNEKLDDYDALNS

SEQ ID NO: 406 - protein, 182 aa, Actinidia deliciosa
MRKLKFHEKKLLKKVNFLEWKREGGHREAQVMQRYHVTGRDDYKKYSVLCRNVQKLVNILKQMDPRDPFRVEMTDALLEKLYNLGVIPSRKSLALCDRLSVSSFCRRRLSTVLVRLKFAEHLKEAITYIEQGHIRVGPETVTDPAFLVTRNMEDFITWVDSSKIKRKVLEYNEKLDDYDAMN

SEQ ID NO: 407 - protein, 182 aa, Lactuca sativa
  misc_feature (123)..(123): Xaa can be any naturally occurring amino acid
  misc_feature (142)..(142): Xaa can be any naturally occurring amino acid
MRKLKFHEKKLLKKVNFLEWKREGGHREAHVMHRYHVTGRDDYKKYSSLCRMAQKLVNILKQMDPRDPYRIEMTDALLEKLYNMGVIPSQKSLALCDKLSVSSFCRRRLATVLVRLKFAEHLXEAVTYIEQGHVRVGPDTVXDPAFLVTRNMEDFITWVDTSKIKRKVMVYNDKLDDYDAMV

SEQ ID NO: 408 - protein, 183 aa, Cucumis melo
MRKLKFHEQKLLKKVNFLEWKREGGHREAQVMHRYHITGRDDYKKYSSLCRGVQKLVTMLKKMNEKDPFRLELTEKLLEKLYNMGVIPTRQSLNLCDRLSVSSFCRRRLSTVLVRLKFAEHLREAVTYIEQGHIRVGPETVTDPAFLVTRNMEDFITWVDSSKIKRKVLQYNDQLDDYDAINC

SEQ ID NO: 409 - protein, 183 aa, Raphanus sativus
MRKLKYHEKKVLKKVNFLEWKRERGHLENLITGRYHMGGRDDYKKYSGLSRMVQKLTNVLKQMDATDPFRIQMTDNLLEKLYNMGVIPTRKSLALTDRLSVSSFCRRRLSTVLVHLKYAEHLKEAVTYIEQGHIRVGPDTITDPAFLVTRNMEDFITWVDSSKIKRKVLQYNDKLDDYDMMLA

SEQ ID NO: 410 - protein, 183 aa, Raphanus sativus; identical to SEQ ID NO: 409

SEQ ID NO: 411 - protein, 182 aa, Glycine max
MRKLKFHEKKLLKKVNFLEWKREGGHRENLIMQRYHVTGRDDYKKYSGLCHMVQKLVNILKQMDPKDPFRVDMTDKLLEKLYNMGVIPTRQSITLCERLTVSSFCRRRLSTVLVRLKFAEHLKEAVTYIEQGHIRVGPETVTDPAFLVTRNMEDFVTWVDSSKIKRKVLQYNDKLDDYDLMN

SEQ ID NO: 412 - protein, 182 aa, Glycine max; identical to SEQ ID NO: 411

SEQ ID NO: 413 - protein, 182 aa, Helianthus annuus
MRKLKFHEKKLLKKVNFLEWKREGGHREAHVMHRYHVTGRDDYKKYSSLCRMTQKLVNILKQMDPKDPYRIEMTDALLEKLYNMGVIPSQKSLALCDRLSVSSFCRRRLATVLVRLKFAEHLKEAVTYIEQGHIRVGPDTVTDPAFLVTRNMEDFITWVDTSKIKRKVMVYNDKLDDYDAMA

SEQ ID NO: 414 - protein, 59 aa, Thellungiella halophila
MRKLKPHEKKLLKKVNFLVWKREGGHREHLITHRYHMGERDDYKKYSGLCRMVQKLTNV

SEQ ID NO: 415 - protein, 182 aa, Triphysaria pusilla
MRKLKFHEKKLLKKVNFLEWKREGGQRENSIIHRYHITARDDYKKYSSLCRMVQKLVNILKQMDSRDPYRIQMTDALLEKLYNMGVIPSRKSLALCERLSVSSFCRRRIATLLVKLKFAEHLKEAVTYIEQGHIRVGPDTITDPAFLVTRNMEDFITWVDTSKIRRKVLEYNDKLDDFDAMN

SEQ ID NO: 416 - protein, 328 aa, Arabidopsis thaliana
MTSDALTIPSELESALRLRTVQYFITKRPWLDLYGVHVRPVPPFGSTSRKPHFDPALIHRCLPDELLFEVFARMMPYDLGRASCVCRKWRYTVRNPMFWRNACLKAWQTAGVIENYKILQSKYDGSWRKMWLLRSRVRTDGLYVSRNTYIRAGIAEWKITNPVHIVCYYRYIRFYPSGRFLYKNSSQKLKDVAKYMNFKASKSENLYKGTYTLSMSDDKIEAAVLYPGTRPTVLRIRLRLRGTAIGANNRMDLLSLVTSGVNDEEISSTEEDILGLVEGWEDDETHNPDIPAVSHKRGMTAFVFVPFEEVDESVLNLPPEKMDYYVTG

SEQ ID NO: 417 - protein, 328 aa, Brassica oleracea
  misc_feature (303)..(303): Xaa can be any naturally occurring amino acid
MTSDALNIPSELESALRLRTVQYFITKRPWLDLYGVHVRPVAPFGSTSSKPQFDPALIHRSLPDELLFEVFARMLPYDLGRAACVCRKWRYTVRNPVFWRNACLKAWQTAGVIENYRILQSKYDGSWRKMWLLRSRVRTDGIYVSRNTYIRAGIAEWKITNPVHIVCYFRYIRFYPSGRFLYKNSSQKLKDVAKYMNFKSSKADGLYRGTYTLSMTDDKIEAAVLYPGTLPTVLRIRLRLRGTAIGANNRMDLLSLVTSGVNDEEGSSTEEDILGVVENWRDDETHNPDIPAVSHKRGMTPFXFVPFEEVEQSVLNLPPEKMDYFVTG

SEQ ID NO: 418 - protein, 298 aa, Brassica rapa
  misc_feature (212)..(212): Xaa can be any naturally occurring amino acid
MTSDALNIPSELESALRLRTVQYFITKRPWLDLYGVHVRPVAPFGSTSSKPQFDPALIHRSLPDELLFEVFARMLPYDLGRAACVCRKWRYTVRNPVFWRNACLKAWQTAGVIENYRILQSKYDGSWRKMWLLRSRVRTDGIYVSRNTYIRAGIAEWKITNPVHIVCYFRYIRFYPSGRFLYKNSSQKLKDVAKYMNFKSSKADGLYRGTYXLSMTDDKIEAAVLYPGTRPTVLRIRLRLRGTAIGANNRMDLLSLVTSGVNDEEGSSTEEDILGVVEIGETMKLTTRIYLPSHTRGV

SEQ ID NO: 419 - protein, 363 aa, Gossypium hirsutum
  misc_feature (17)..(17): Xaa can be any naturally occurring amino acid
IFYFLLILKYRGLVNLXRGEKISFNFPLRFIKFIVDSIPMNPVPSEVELESALRLKTVQYFVTQRPWLDLYGKHVRPVAPFGSASRRSYVDPALIHRSLPDELLFEVFVRMAPYDLGRASCVCRKWRYTIRNPVFWRTACLKAWQLSGLVENYKILQSKYEGSWRKMWLLRPRVRTDGLYVSRNTYIRAGVAEWKITNPVHIVCYFRYLRFFPSGRFLYKNSSQKIKDAAKFMNFRASKADCVFGGHYTLSDNKVEAAVLYPGMRPTVLRIRLRLRGTTAGANNRMDLLSLVTSGVDDNEASGPEEDILGVVEGWQDDETHNPDVPAVSHKRGLTPFVFVPFEEVETSDLNLPVEKMDYYVPG

SEQ ID NO: 420 - protein, 329 aa, Arachis hypogaea
MASSSDFALSVPSELESVLRLRTVDYFITRRPWLDLYGVNVRPVAPFGSASRKPYVESALIHQCLPDELLFEVFARMTPYDLGKASCVCRKWRYTIRNPVFWRVACLKAWQLSGVVENYRILQSKYDGSWRKMWLSRPRLRTDGIYVSRNTYIRAGVAEWKITNPVHLVCYFRYMRFFPSGRFLYKNSSQKIKDVVKFMNFRSSKVDSVFGGHYTLSDDKVEAAVLYPGMRPTVLRIRLRVRGTTPGANNRMDLISLVTSGVNNSEASAPEEDILGVVEGWRDDETHNPDVPAVSHKRGMTPFVFVPFDQVETSVFNLPVEKMDYYVPG

SEQ ID NO: 421 - protein, 328 aa, Raphanus sativus
MTSDALNIPSELESALRLRTVQYFITKRPWLDLYGVHVRPVAPFGSTSSKPQFDPALIHRSLPDELLFEVFARMLPYDLGRAACVCRKWRYTVRNPVFWRNACLKAWQTAGVIENYRILQSKYDGSWRKMWLLRSRVRTDGIYVSRNTYIRAGIAEWKITNPVHIVCYFRYIRFYPSGRFLYKNSSQKLKDVAKYMNFKSSKTDGLYRGTYTLSMSDDKIEAAVLYPGTRPTVLRIRLRLRGTAIGANNRMDLLSLVTSGVNDEEGSSTEEDILGVVENWRDDETHNPDIPAVSHKRGMTPFVFVPFEEVEQSVLNLPPEKMDYFVTG

SEQ ID NO: 422 - protein, 329 aa, Glycine max
MASASDFALAVSSELESVLRLKTVNYFVTRRPWLDLYGVNVRPVAPVGSASRRPYVDPALIHRSLPDELLFEVFARMTPYDLGKASCVCRKWKYTIRNPVFWRNACLKAWQLFGIVENYKILQSKYDGSWRKMWLLRPRLRTDGLYVSRNTYIRAGVAEWKITNPVHVVCYFRYLRFFPSGRFLYKNSSQKIKDVAKCMNFRSSKIDCVFGGHYTLSDDKVEAAVLYPGMRPTVLRIRLRLRGTTTGANNRMDLISLVTSGVNSSEASAPEEDILGVVEGWQDDETHNPDVPAVSHKRGMTPFVFVPFEEVETSVLNLPVEKMDYFVPG

SEQ ID NO: 423 - protein, 329 aa, Glycine max
MASGSDFALAVSSELESVLRLETVNYFVTRRPWLDLYGVNVRPVAPVGSASRRPYVDPALIHRSLPDELLFEVFARMTPYDLGRASCVCRKWKYTIRNPVFWRNACLKAWQLSGIVENYRILQSKYDGSWRKMWLSRPRLRTDGLYVSRNTYIRAGVAEWKITNPVHVVCYFRYLRFFPSGRFLYKNSSQKVKDVAKCMNFRSSKADCVFGGHYTLSDDKVEAAVLYPGMRPTVLRIRLRIRGTTSGANNRMDLISLVTSGVNSSEASAPEEDILGVVEGWQDDETHNPDVPAVSHKRGMTPFVFVPFEEVETSVLNLPVEKMDYFVPG

SEQ ID NO: 424 - protein, 867 aa, Arabidopsis thaliana
MKVAVIGSGISGLGSAYVLANQGVKEVVLYEKEESLGGHAKTVRFDGVDLDLGFMVFNRVTYPNMMEFFENLGVEMEVSDMSFAVSLDNGKGCEWGSRNGVSGLFAQKKNVLNPYFWQMIREIVRFKEDVLKYIEELEGNPDIDRKETLGEFLNSRGYSELFQQAYLVPICGSIWSCPSDGVLSFSAYSVLSFCCNHHLLQIFGRPQWLTVAGRSQTYVAKVRTELERLGCRIRTSCDVKSVSTSENGCVTVTSGDGSKEVFDRCILAMHAPDALRLLGEEVTFDESRVLGAFQYVYSDIYLHHDIDLMPRNQAAWSAWNFLGSTEKKVCVTYWLNILQNLGENSEPFFVTLNPDETPKKTLLKWTTGHPVPSVAAWTASQELHKIQGKRNIWFCGAYQGYGFHEDGLKAGMAAARGLLGKETALLNNPRHMVPSLTETGARLFVTRFLGQFISTGSVTILEEGGTMFTFGGKDSTCPLKSILKIHSPQFYWKVMTQADLGLADAYINGDFSFVDKESGLLNLIMILIANRDTKSNLSKKRGWWTPMFLTAGLASAKYFLKHVSRQNTLTQARRNISRHYDLSNELFGFFLDDTMTYSSAVFKSDDEDLRTAQMRKISLLIDKARIEKDHEVLEIGCGWGTLAIEVVRRTGCKYTGITLSIEQLKYAEEKVKEAGLQDWITFELRDYRQLSDAQKYDRIISCEMLEAVGHEFMEMFFSRCEAALAENGLIVLQFISIPEERYNEYRLSSDFIKEYIFPGGCLPSLARVTTAMSSSSRLCIEHVENIGIHYYQTLRLWRKNFLARQKQIMALGFDDKFVRTWEYYFDYCAAGFKTLTLGNYQLVFSRPGNVAAFADSYRGFPSAYCVT

SEQ ID NO: 425 - protein, 434 aa, Arabidopsis thaliana
MSHLDDIPSTPGKFKMMDKSPFFLHRTRWQSSVAKLAFWSLVFFGLLFIFFYRSPISNPDSSRRSLRTYSWGGPAWEKRVRSSARVRTRNGVSVLVTGAAGFVGTHVSAALKRRGDGVLGLDNFNDYYDTSLKRSRQALLERSGVFIVEGDINDLSLLKKLFEVVPFTHVMHLAAQAGVRYAMENPGSYVHSNIAGFVNLLEVCKSANPQPAIVWASSSSVYGLNTKVPFSEKDRTDQPASLYAATKKAGEEIAHTYNHIYGLSLTGLRFFTVYGPWGRPDMAYFFFTRDILKGKAISIFEGANHGTVARDFTYIDDIVKGCLGALDTAEKSTGSGGKKRGAAQLRVFNLGNTSPVPVTDLVSILERLLKVKAKRNMMKLPRNGDVPFTHANISSAQREFGYKPSTDLQTGLKKFVRWYLGYYKQGGKKVAAAA

SEQ ID NO: 426 - protein, 67 aa, Arabidopsis thaliana
GILIKFFFAFTFNCLSNILTRSETGTGDVFPRLNTLNCAGPLFFPPLPVLFSAVSSAAKHPFTISSM

SEQ ID NO: 427 - protein, 427 aa, Arabidopsis thaliana
MSHLDDIPSTPGKFKPYFHRTRWQSSVAKLAFWSLVFVGLIFIFFYRSPVSSNPADPSRRSLRTYSWGGPAWEKRVRSSARLRTRRGFSVLVTGAAGFVGTHVSAALKRRGDGVLGLDNFNDYYDPSLKRARQALLERSGVFVVEGDINDAALLKKLFEVVPFTHVMHLAAQAGVRYAMENPSSYVHSNIAGFVNLLEVCKSANPQPAIVWASSSSVYGLNTKVPFSEKDRTDQPASLYAATKKAGEEIAHTYNHIYGLSLTGLRFFTVYGPWGRPDMAYFFFTRDILKGKAISIFEGVNHGTVARDFTYIDDIVKGCLGALDTAEKSTGSGGKKRGAAQLRVFNLGNTSPVPVTDLVTILERLLKVKAKRNIMKLPRNGDVQFTHANISSAQRELGYKPTTDLQTGLKKFARWYLGYYNGGKKAAS

SEQ ID NO: 428 - protein, 430 aa, Brassica rapa
  misc_feature (252)..(252): Xaa can be any naturally occurring amino acid
MKHLDETPSTPGKFKMDKSPYFLHRTRWQSSVAKLAFWSLVFVGFIFIFFYRSPSSLPDPSRRSLRTYSWGGPAWEKRVRSSAHVRTRRGVSVLVTGAAGFVGTHVSAALKRRGDGVLGLDNFNDYYDPSLKRARQALLERSGVFVVEGDINDAALLKKLFEVVPFTHVMHLAAQAGVRYAMENPSSYVHSNIAGFVNLLEVCKSANPQPAIVWASSSSVYGLNTKVPFSEKDRTDQPASLYAATKKAGEEXAHTYNHIYGLSLTGLRFFTVYGPWGRPDMAYFFFTRDILKGKPISVFQGANHGTVARDFTYIDDIVKGCLGALDTAEKSTGSGGKKRGAAQLRVFNLGNTSPVPVTDLVTILERLLKVKAKRNIVKMPRNGDVPFTHANISSAQRELGYKPTTDLQTGLKKFARWYLGYYNGGKKAAS

SEQ ID NO: 429 - protein, 430 aa, Brassica napus
MKHLDETPSTPGKFKMDKSPYFLHRTRWQSSVAKLAFWSLVFVGFIFIFFYRSPSSLPDPSRRSLRTYSWGGPAWEKRVRSSAHVRTRRGVSVLVTGAAGFVGTHVSAALKRRGDGVLGLDNFNDYYDPSLKRARQALLERSGVFVVEGDINDAALLKKLFEVVPFTHVMHLAAQAGVRYAMENPSSYVHSNIAGFVNLLEVCKSANPQPAIVWASSSSVYGLNTKVPFSEKDRTDQPASLYAATKKAGEEIAHTYNHIYGLSLTGLRFFTVYGPWGRPDMAYFFFTRDILKGKPISVFQGANHGTVARDFTYIDDIVKGCLGALDTAEKSTGSGGKKRGAAQLRVFNLGNTSPVPVTDLVTILERLLKVKAKRNIVKMPRNGDVPFTHANISSAQRELGYKPTTDLQTGLKKFARWYLGYYNGGKKAAS

SEQ ID NO: 430 - protein, 433 aa, Citrus sinensis
MSHLDNIPSTPGKFKMDKSPYFNRLRFHSSLAKLTFWSFIFLAVILIFFFRSPSSNPLPSADPSRRSLRTYDWGGPAFEKRVRSSARVRARNGISVLVTGAAGFVGTHVSAALKRRGDGVLGLDNFNDYYDPSLKKARQALLERSGIFIVEGDINDMALLKKLFDVVSFTHVMHLAAQAGVRYAMQNPNSYVHSNIAGLVSLLEVCKNANPQPAIVWASSSSVYGLNTKVPFSEKDRTDQPASLYAATKKAGEEIAHTYNHIYGLSLTGLRFFTVYGPWGRPDMAYFFFTRDILNRKSIPIFESPDHGTVARDFTYIDDIVKGCLAALDTAEKSTGSGGKKRGRAQLRVFNLGNTSPVPVSDLVSILERLLKVKAKRNIMKLPRNGDVPFTHANISLAQRELGYKPTTDLQTGLKKFVRWYLSYYAGGKKAAG

SEQ ID NO: 431 - protein, 432 aa, Glycine max
MSHIDSAPPTPGKFKMDKASYFNRVRWHTSLAKLAVWSFVFLGAILIFFLRSPASSPVPADLSRRSLRTYNWGGPVWEKRVRASAQVRSRNGFAVLVTGAAGFVGTHVSAALKRRGDGVLGLDNFNDYYDPSLKRARQGLLERNGVYIVEGDINDEALLRKLFEVVPFTHVMHLAAQAGVRYAMENPGSYVHSNIAGFVNLLEVCKSVNPQPAIVWASSSSVYGLNTKVPFSERDRTDQPASLYAATKKAGEEIAHTYNHIYGLSLTGLRFFTVYGPWGRPDMAYFFFTRDLLKGKPIPIFEAANHGTVARDFTYIDDIVRGCLGALDTAEKSTGSGGKKRGPAQLRVFNLGNTSPVPVSDLVSILERLLKVKAKRNIMKLPRNGDVQFTHANISYAQSELGYKPTTDLQSGLKKFVRWYLNYYSGGKKAVE

SEQ ID NO: 432 - protein, 432 aa, Glycine max
MSHIDSAPSTPGKFKMEKASYFNRVRWHTSLAKLAVWSFVFLGAILIFFLRSPASSPVPADLSRRSLRTYNWGGPVWEKRVRASAQIRSRNGFAVLVTGAAGFVGTHVSAALKRRGDGVLGLDNFNDYYDPSLKRARQGLLERSGVYIVEGDINDEALLRKLFEVVPFTHVMHLAAQAGVRYAMENPGSYVHSNIAGFVNLLEVCKSVNPQPAIVWASSSSVYGLNTKVPFSERDRTDQPASLYAATKKAGEEIAHTYNHIYGLSLTGLRFFTVYGPWGRPDMAYFFFTRDLLKGKSIPIFEAANHGTVARDFTYIDDIVRGCLGALDTAEKSTGSGGKKRGPAQLRIFNLGNTSPVPVSDLVSILERLLKVKAKRNIMKLPRNGDVQFTHANISYAQMELGYKPTTDLQSGLKKFVRWYLNYYSGGKKAVE

SEQ ID NO: 433 - protein, 292 aa, Solanum lycopersicum
  misc_feature (81)..(82): Xaa can be any naturally occurring amino acid
  misc_feature (249)..(249): Xaa can be any naturally occurring amino acid
MMHIDNIPSTPGKFKMEKSPYNRLRMHFSLAKLTFWSFVFLGLIFVFFYRSPASSSPVSSDLSRRSLRTSSYGGPAWEKRXXASAKVRSRNGISVLVTGAAGFVGTHVSVALKRRGDGVLGLDNFNDYYDPSLKRARQALLERTGVYVVEGDINDATLLKKLFDIVPFTHVMHLAAQAGVRYAMENPGSYVHSNIAGLVNVLEICKSVNPQPAIVWASSSSVYGLNTKVPFSEKDRTDQPASLYAATKXAGEEIAHTYNHIYGLSLTGLRFFTVYGPWGRPDMAYFFFTGIS

SEQ ID NO: 434 - protein, 114 aa, Brassica rapa
MVIPPAVRPPRLFDYLKPYVLKMHFTNKFVHAQVIHSPTATVACAASSQEKALRETMGVTRDVAAASKIGKILGERLLMKDIPAVAIHMKKEQRYHGKVKAVIDSVREAGVKLL

SEQ ID NO: 435 - protein, 114 aa, Brassica rapa
  misc_feature (88)..(88): Xaa can be any naturally occurring amino acid
MVIPPAVRPPRLFNYLKPYVLKMHFTNKFVHAQVIHSPTATVACSASSQEKALRETMEVTRDVAAASKIGRILGERLLIKDIPAVAIXMKKEQRYHGKVKAVIDSVREAGVKLL

SEQ ID NO: 436 - protein, 114 aa, Brassica napus
MVIPLAVRPPRLFDYLKPYVLKMHFTNKFVHAQVIHSPTATVACAASSQEKALRETMGVTRDVAAASKIGKILGERLLMKDIPAVAIHMKKEQRYHGKVKAVIDSVREAGVKLL

SEQ ID NO: 437 - protein, 114 aa, Brassica napus
MVIPPAVRPPRLFDYLKPYVLKLHFTNKFVHAQVIHSPTATVACSASSQEKALRETMGVTRDVAAAAKIGKLLGERLLLKDIPAVTIHMKKEQMYHGKVKAVIDSVREAGVKLL

SEQ ID NO: 438 - protein, 114 aa, Brassica napus
MVIPPAVRPPRLFNYLKPYVLKMHFTNKFVHAQVIHSPTATVACSASSQEKALRETMEVTRDVAAASKIGRILGERLLIKDIPAVAIQMKKEQRYHGKVKAVIDSVREAGVKLL

SEQ ID NO: 439 - protein, 114 aa, Brassica napus
MVIPPAVRPPRLFDYLKPYVLKMHFTNKFVHAQVIHSPTATVACAASSQEKALRETMGVTRDVAAASMIGKILGERLLMKDIPAVAIHMKKEQRYHGKVKAVIDSVREAGVKLL

SEQ ID NO: 440 - protein, 115 aa, Manihot esculenta
MVIPPPVKWPPRVREFLKPYILKMHFTNKFVSAQVIHSPSATVACSASSQEKALRSSMENTRDVAAAAKIGKILGERLLLKDIPAVSIFLKREQRYHGKVKAVIDSVREAGVKLL

SEQ ID NO: 441 - protein, 114 aa, Citrus sinensis
MVIPPPVRPPKLSNFLKPYVLRMHFTNKYVSAQVIHSPTATVASSATSQEKALRSSIGCTRDVAAASKIGKILGERLLLKDIPAVTVFLKREQRYHGKVKAVIDSLREAGVKLL

SEQ ID NO: 442 - protein, 114 aa, Carica papaya
MVIPPPVRPPRILHFLKPYVLKMHFTNKFVHAQVIHSPTATVASSASSQEKALRGSMGSTRDVAAAAKIGKILGERLLQNDIPAVSVFLKREQKYHGKVKAVIDSLKEAGVKLL

SEQ ID NO: 443 - protein, 114 aa, Raphanus sativus
MVIPPAVRPPRLFDYLKPYVLKMHFTNKFVHAQVIHSPTATVACSASSQEKALRETMGVTRDVAAASKIGKILGERLLSKDIPAVAIHMKKEQRYHGKVKAVIDSVREAGVKLL

SEQ ID NO: 444 - protein, 114 aa, Raphanus sativus
  misc_feature (24)..(24): Xaa can be any naturally occurring amino acid
MVIPPAVRPPRLFDYLKPYVLKMXFTNKFVHAQVIHSPTATVACSASSQEKALRETMNVTRDVAAASKIGKLLGERLLMKDIPAVTIHMKKEQMYHGKVKAVIDSVREAGVKLL

SEQ ID NO: 445 - protein, 423 aa, Brassica napus
  misc_feature (383)..(383): Xaa can be any naturally occurring amino acid
  misc_feature (423)..(423): Xaa can be any naturally occurring amino acid
MKLKWESISTLHQNVFLVKVLAAVFITGLAFRFYAVRFGQVSVNEISDPQISPPSVIISENEDLLPIDIEVEKCDLFTGKWIRDPLGPIYTNGSCGVVVDSHQNCITNGRPDSGFLYWKWKPNDCSLPRFDALRFLQLMRNKSWAFIGDSISRNHVESLLCMLSTVEKPVEVYHDEEYRSKRWLFPLHNLTISNIWSPFLVKAAIFEDSSGVSSAAVQLHLDILDNTWTDLFPSIDFAIIFSGEWFLKTAVYHENATLVGCHGCPQSSNITDLGFDYAYNTSLRHVMDFIARSNTKGMIFFRTSIPDHFENGEWHNGGTCKKTEPVNEDEVEMKVLNKILRDVEISQFERVVTEMGQEAGHFKLLDFAGMLLTRPDGHPGPYXEFRPFDKDKNAKVQNDCLHWCLPGPIDYLNDVILEIIVNX

SEQ ID NO: 446 - protein, 44 aa, Arabidopsis thaliana
MWLSHELLPRGLRRIEMVPTSIVEETKCFKCMYCCEFYRLMSLV

SEQ ID NO: 447 - protein, 333 aa, Arabidopsis thaliana
MLFLTAAVCLICFYVYKSVKPPPPIPLPENVSEISPRIKLNDGRYLAYKELGFPKDKAKNKIIILHGFGSSKLVDLKITQEMIDEFEIYFLLFDRAGYGESDPHPSRTLKTDTYDIEELADKLQIGPKFHVLGMSLGAYPVYGCLKYIPHRLSGATLVVPILNFWWSCLPLNLSISAFKKLPIQNQWTLGVAHYFPWLLYWWMTQKWFSPFSQNPRETMTERDIELADKHTKHAYIKESALRQGEYVSMQRDIIAGYENWEFDPTELSNPFSDDNKGSVHIWCALEDKQISHEVLLYLCDKLPWIKLHEVPDAGHLIIHEKQHFEDIIKAACS

SEQ ID NO: 448 - protein, 332 aa, Brassica napus
MLLLLAIVGLTSYYVYKLIKPPPPIPLPENVTKKSPRIKLSDGRHIAYKELGFPKDEAKNKIIIIHGYANSKDVDLYTTQEMIDEFKIYFLFFDRAGYGESDPNPSRTLKTDTYDIEELADKLQLGPRFHVLGMSLGAYPVYGCLKYIPHRLSGASLAVPLINFWWRRIPQNLLNAAIKKLPFEFQMTLRVAHYCPWLLYWWMTQKWFPSNRDPKKTLTERDIELSETYSKKSYKDAVLRQGEYVSSQRDIIAGYGNWEFDPTELSNPFSDTNKGSVHIWCALDDKQILRDVLVYICDKLPWIKFHEVPHAGHWIIHEKKHFEAIIKAACTE

SEQ ID NO: 449 - protein, 593 aa, Raphanus sativus
  misc_feature (139)..(139): Xaa can be any naturally occurring amino acid
  misc_feature (157)..(157): Xaa can be any naturally occurring amino acid
MENPPDQTESKEMMLQPIRRRRKGGLLTMPFIIANEGFEKVASYGLLQNMILYLMSDYGLGIVKGQTVLFMWVAATNFMPLVGAFLSDSYLGRFLTIAIASLSSFLGMVLLWLTAMLPQVKPSPCIASAGTNCSSPAAXSSQLALLYSAFALISIGXGGIRPCSLAFGADQLDNKENPKNERVLESFFGWYYASSSVAVLIAFTVIVYIQDHLGWRIGFGIPAILMLLASLVFVLASPLYVKRNVSKSLFTGLAQAAVAAYVNRKLMLPGQSDSYGCYHHLKDSELKAPSDKLRFLNKACVIRNRDEDIGSDGLALNPWRLYTTDQVEELKALVKVIPVWSTGIMMSINVSQNSFQLLQANSMDRRLSDDSTFKIPAGSFGMFTIIALISWVVLYDRAILPLASKIRGRPVRINVKIRMGLGLFISFLAMAVSATVEHYRRRTAISQGLADNATATVNISAMWLVPQYVLHGLAEALTGIGQTEFFYTEFPKSMSSIAAALFGLGMAVANILASVILNVIKNSSKKGGVSWIEDNINKGHYDYYYWVLAIMSFVNVIYYVVCSWSYGPTVDQVRNDKVNGVREEEQEEVVKIN

SEQ ID NO: 450 - protein, 491 aa, Brassica napus
MALRHLSRPRDIVKRSTKKYLDEPLYHRLFKDGGSEVSVRQQLNHFLKGTKHVFKWEVGDTIKKLRSRGLYYPALKLSEVMEHRGMNKTVSDQAIHLDLVAKARGIAAGESYFVGLPETSKTELTYASLLNCYCKELMTEKAEGLLSKMKELNITVSSMSYNSLMTLYTKTGQAERVPGMIQEMKAEDVMPDSYTYNVWMRALAATEDVSGVERVIEEMNRDGRVAPDWTTYSNMASIYVDAGLSEKAEKALQELEMKNTERDFKAYQFLVTLYGRLGKLNEVYRIWRSLRLAMPKTSNVAYLNMIQVLVNLKDLPGAETLFKEWQANCSTYDIRVVNVMIGAYAREGLIEKANELKEKSPRRGGKLNAKTWELFMDYYVKRGETAQALECITKAVSIGKGDGGKWLPSEDTVRALMSQFEEKKDVNGAESLLEILKKGTDDVGAETFESLIRTYAAAGKSHPAMRQRLKMEKVKVDKATEKLLDELCQDE

SEQ ID NO: 451 - protein, 493 aa, Brassica napus
KMALRHLSRPRDIVKRSTKKYLEEPLYHRLFKNGGSEVSVRQQLNQFLKGTNHVFKWEVGDTIKKLRSRGLYYPALKLSEVMEHRGLNKTVSDQAIHLDLVAKARGIAAGETYFVNLPETSKTELTYASLLNCYCKELMTEKAEGLLNKMKELNITVSSMSYNSLMTLYTKTGQAERVPGMVQEMKAENVMPDSYTYNVWMRALAATDDVSGVERVIEEMNRDGRVAPDWTTYSNMASIYVDARLSEKAEKALQELEMKNTDRDFKAYQFLSTLYGRLGKLSEVYRIWRSLRLAIPKTSNVAYLNMIQVLVNLKDVTGAETLFKEWQANCTTYDIRVVNVMIGAYAKEGLIEKAKELKEKAPRRGGKPNAKTWEIFMDYYVKSCETAQALECISKAVSIGKGDGGKWLPSQEAISTLMSQFEVKKDVNGAENLLEIFKKGTDDSIGAEIFESLVRTYAAAGKSHPAMRQRLKMEKVEVNEATQKLLDALCRQE

SEQ ID NO: 452 - protein, 240 aa, Brassica rapa
  misc_feature (188)..(188): Xaa can be any naturally occurring amino acid
MNPNQVPNGFVKPVPTEEEKGKIEELRKLLGPLPEKLSGFCSDDAVLRYLRARNWHVKKAAKMLKETLKWRVQYKPEEICWEEIADEAETGKIYRSSCVDKHGRPVLIMRPSVENSKSVKGQIRYLVYCMENAIQNLPPGEEQMVWMIDFNGYSLVNVSLKTTRETAHVLQEHYPERLSLAILYNPPXFFEPFWKVARPFLEPKTRNKVKFVYSDDPNTKQIMEENFEHGQNGVSVWWKR

SEQ ID NO: 453 - protein, 314 aa, Raphanus sativus
  misc_feature (139)..(139): Xaa can be any naturally occurring amino acid
  misc_feature (230)..(230): Xaa can be any naturally occurring amino acid
MNPNQVPNGFVKPVPTEEEKGKIEELRKLLGPLPEKLSSFCSDDAVLRYLRARNWHVKKAAKMLKETLKWRVQYKPEEICWEEIADEAETGKIYRSSCVDKHGRPVLIMRPSVENSKSMKGQIRYLVYCMENAIQNLPXGEEQMVWMIDFNGYSLANVSLRTTRETAHVLQEHYPERLSLAILYNPPKFFEPFWKVARPFLEPKTRNKVNFVYSDDPNTKQIMEENFDMXKMESAFGGNDDSGFNIDKHSERMKEDDKKRLAALKDIASPSLDSLSFLSVSDGATSDSAHLGSEDVSEDEQQPHGMNEKKESIP

SEQ ID NO: 454 - protein, 255 aa, Malus domestica
MLAIFHKAFAHPPDELNSPASYNGSKKPKHPEETLRDFLSHHPHNSLSMGFGDAAVLAYVKPDQGSYSKHQRLFCGFDDIYCLFLGSLNNLCLLNKQYGLTKCSNEAMFVIEAYRTLRDRGPYPADQVVKDLEGSFAFVVYDSKGGNVFAALGSDGGEQLYWGIAADGSVVISDELEVIKEGCAKSFAPFPKGCMFHSEGGLMSFEHPMNKMKAMPRVDSEGAMCGANFKVDKYTRVNSIPRVGSEADWTEWASH

SEQ ID NO: 455 - protein, 255 aa, Malus domestica
  misc_feature (244)..(244): Xaa can be any naturally occurring amino acid
MLAIFHKAFAHPPEELNSPASYNGSKKPKHPEETLTDFLSHHPHNSFSMGFGHAAVLAYVKPDQGSYSKHPRLFCGFDDIYCLFLGSLNNLCSLNKQYGLTKCTNEAMFVIEAYRTLRDRGPYPADQVVKDLDGSFAFVVYDSKGGNVFAALGSDGGEQLYWGIAADGSVVISDELEVIKEGCAKSFAPFPKGCMFHSEGGLMSFEHPMNKMKAMPRVDSEGAMCGANFKVDKYTRVNSIPRVXSEANWTDWASH

SEQ ID NO: 456 - protein, 250 aa, Brassica oleracea
MLAIFHEAFAHPPEELHSPASEKCSKQPKLPEETLNSFLSRYPLNTFSMSFGKAAVLAYVRPSASFSIHQRLFCGFDDIYCLFFGSLNNLCQLNKQYGLTKTTNEAMFVIEAYRTLRDRGPYPADQVVKDLDGSFAFVVYDSKAGSVFTALGSDGGVKLFWGIAADGSVVISDDLDVIKEGCAKSFAPFPTGCMFHSEGGLMSFEHPMNKIKAMPRVDSEGVLCGANFKVDVYSRVNSIPRRGSEANWSL

SEQ ID NO: 457 - protein, 218 aa, Brassica oleracea
MLAIFHEAFAHPPEELYSPASEKCSKQPKLPEETLNDFLSRHSDNTFSMSFGKAAVLAYVRPSASFSVHQRLFCGFDDIYCLFFGSLNNLCQLNKQYGLTKTTNEAMFVIEAYRTLRDRGPYPADQVVKDLDGSFAFVVYDSKAGSVFTALGSDGGVKLFWGIAADGSVVISDDLDVIKEGCAKSFAPFPTGCMFHSEGGLMSFEHPMNKIKAMPRVD

SEQ ID NO: 458 - protein, 250 aa, Brassica rapa
MLAIFHEAFAHPPEELYSPASEKCSKQPKLPEETLDDFLSRHSDNTFSMSFGKAAVLAYVRPSASFSVHQRLFCGFDDIYCLFFGSLNNLCQLNKQYGLTKTTNEAMFVIEAYRTLRDRGPYPADQVVKDLDGSFAFVVYDSKAGSVFTALGSDGGVKLFWGIAADGSVVISDDLDVIKEGCAKSFAPFPTGCMFHSEGGLMSFEHPMNKIKAMPRVDSEGVLCGANFKVDVYTRVNSIPRRGSEANWSL

SEQ ID NO: 459 - protein, 250 aa, Brassica rapa
MLAIFHEAFAHPPEELHSPASEKCSKQPKLPEETLNSFLSRYPLNTFSMSFGKAAVLAYVRPSASFSVHQRVFCGFDDIYCLFFGSLNNLCQLNKQYGLTKTTNEAMFVIEAYRTLRDRGPYPADQVVKDLDGSFAFVVYDSKAGSVFTALGSDGGVKLFWGIAADGSVVISDDLDVIKDGCAKSFAPFPTGCMFHSEGGLMSFEHPMNKIKAMPRVDSEGVLCGANFKVDVYSRVNSIPRRGSEANWSL

SEQ ID NO: 460 - protein, 254 aa, Phaseolus coccineus
MLAIFHKAFAHPPEELNSPASYQGSKKPKVPQETLKDFLAHHPHNTCSMSFGHAAVLAYVRPDQPFSLHQRLFCGIDDIYCIFLGSLNNLSLLIKQYGLSKNTDEAMLVIEAYKTLRDRGPYPADQVVKELDGSFAFVVYDSKVGSVFAALGSDGGIKLYWGIAADGSVVISDDLQVIKEGCAKSFAPFPTGCMFHSEGGLMSFEHPMNKLKAMPRVDSEGAMCGANFKVDKFSRVNSIPRVGSQSNWMEWDQH

SEQ ID NO: 461 - protein, 254 aa, Theobroma cacao
MLAIFHKACANPPEDLNSPASHKSSKKPKLPEETLNEFHSHHPHNTFSMSFGNAAVLAYVRPESPYLVHQRLFCGFDDIYCLFLGSLNNLCTLNRQYGLSKGSNEAMFVIEAYRTLRDRGPYPADQVVKDLDGSFAFVIYDSKAGTVFAALGSDGGVKLYWGIAADGSVVISDDLEVIKEGCAKSFAPFPTGFMFHSEGGLMSFEHPMNKIRAMPRTDSEGVICGANFKVDVYARVNSIPRVGSETNWTHWDSH

SEQ ID NO: 462 - protein, 250 aa, Brassica napus; identical to SEQ ID NO: 458

SEQ ID NO: 463 - protein, 250 aa, Brassica napus; identical to SEQ ID NO: 456

SEQ ID NO: 464 - protein, 250 aa, Brassica napus
MLAIFHEAFAHPPEELYSPASEKCSKQPKLPEETLNDFLSRHSDNTFSMSFGKAAVLAYVRPSASFSVHQRLFCGFDDIYCLFFGSLNNLCQLNKQYGLTKTTNEAMFVIEAYRTLRDRGPYPADQVVKDLDGSFAFVVYDSKAGSVFTALGSDGGVKLFWGIAADGSVVISDDLEVIKEGCAKSFAPFPTGCMFHSEGGLMSFEHPMNKIKAMPRVDSEGVLCGANFKVDVYTRVNSIPRRGSEANWSL

SEQ ID NO: 465 - protein, 255 aa, Manihot esculenta
MLAIFHKAFANPPDELNSPASRNGNKKPKLPEETLREFLSHYPDNTFSMSFGEAAVLAYVRPDNSFSQHQRLFCGFEDIYCLFLGSLNNLCVLNRQYGLTKGTNEAMFVIEAYRTLRDRGPYPADQVVKDLDGSFAFVIYDSKAGTVFVALGSDGGVKMYWGIAADGSVVISDDIEIIKAGCAKSFAPFPAGFMFHSEGGLMSFEHPMNKVRAMPRVDSEGALCGANFKVDVYTRINSIPRRGSEANWTQWDSHN

SEQ ID NO: 466 - protein, 255 aa, Citrus sinensis
MLAIFHKAFANPPEELHSPASQKCSKRPKLPEDTLSDFLSRHSDNTFSMNFGHAAVLAYVPPHSPLTKDRRLFCGFEDIYCLFMGSLNNLCSLIRQYGLSKGTDEAMFVIEAYRTLRDRGPYPADQVVKDLDGSFAFVVYDSKAGTVFTALGSDGGVKLYWGIAADGSVVISDDLEVIKEGCAKSFAPFPQGCMFHSEGGLMSFEHPMNKIRAMPRVDSEGVMCGANFKVDKYTRINSIPRVGSEADWTNQWDSH

SEQ ID NO: 467 - protein, 255 aa, Gossypium hirsutum
MLAIFHKAFANPPEELNSPASHKSTKKPKQPEETLNDFLSHHPHNTFSMSFGNAAVLAYVRHERAASVHQRLFCGFDDIYCLFLGSLNNLFMLNRQYGLSKGSNEAMFVIEAYRTLRDRGPYPADQVVKDLEGSFAFVIYDSKTGTVFAALGSDGGVKLYWGIAADGSVVISDDLDVIKEGCAKSFAPFPTGFMFHSEGGLMSFEHPMNKIRAMPRVDSEGVICGANFKVDVYTRVNSIPRVGSATNWTDHWDSH

SEQ ID NO: 468 - protein, 254 aa, Vigna unguiculata
MLAIFHKAFAHPPEELNSPASYKGSKKPKVPEETLKDFLAHHPQNTCSMSFGHAAVLAYVRPDQPFSRNQRLFCGIDDIYCIFLGSLNNLSLLIKQYGLSKNTDEAMLVIEAYKTLRDRGPYPADQVVKELDGSFAFVVYDSKVGSVFAALGSDGGVKLYWGLAADGSVVISDDLEVIKEGCAKSFAPFPTGCMFHSEGGLMSFEHPMNKLKAMPRVDSEGAMCGANFKVDKFSRVNSIPRVGSQSNWMEWDQH

SEQ ID NO: 469 - protein, 260 aa, Cynara scolymus
  misc_feature (14)..(14): Xaa can be any naturally occurring amino acid
MLAIFHKAFANPPXELKSPASNHSNKPKLPEETLEEFLSVHPTNTFSMTFGDAAVLAYVKPDRPYSVHQRMFTAFDDIYCVFMGSLNNLCAQIKQYGLSKNTDEAMFVIEAYRTLRDRGPYPADQVIKDLEGSFAFVVYDSKSGTVFTALGSDGGVKLYWGIAADGSVVISDDLEVIKAGCAKSFAPFPKGCMFHSEGGLMSFEHPMNKIRAMPRVDSEGVMCGANFKVDTYTRGNSIPRRGSEANWTNGIIIISGYLIP

SEQ ID NO: 470 - protein, 256 aa, Taraxacum officinale
MLAIFHKAFAHPPEELNSPVARHCSKQPKLPEETLEEFLSVHPKNTFSMTFGDAAVLAYVKPDRTNYSVHQRLFTAFDDIYCLFMGSLNNLCAQIKQYGLSKNTNEAMFVIEAYRTLRDRGPYPADQVIKDLEGSFAFVVYDSKTGSVFTALGSDGGVKLYWGIAADGSVVISDDLEVIKTGCAKSFAPFPKGCMFHSEGGLMSFEHPMNKIRAMPRVDSEGVMCGANFKVDKYSRVNSIPRRGSETNWTQWDDHY

SEQ ID NO: 471 - protein, 255 aa, Vitis vinifera
MLAIFHKAFAHPPEELNSPASRDGSRKPKLPEETLREFLSAHPANTFSMSFGTAAALAYVSPDRSYPTHQRLFGGFDDIYCLFMGSLNNLCILNRQYGLSKGSNEAMLVIEAYRTLRDRGPYPADQVVKDLEGSFAFVVYDSKAGTVFTALGSDGGVKLFWGVAADGSVVISDDLGVIKAGCAKSFAPFPTGCMFHSDGGLMSFEHPMNKMKAMPRIDSEGVMCGANFKVDVYSRINSMPRVGSEVNWSNWEDYH

SEQ ID NO: 472 - protein, 255 aa, Lactuca sativa
MLAIFHKAFAHPPEELNSPAAHHCTKQPKLPEETLEEFLSVHPTNTFSMTFGDAAALAYVKPDRPYSVHQRLFTAFDDIYCLFMGSLNNLCSQIKQYGLSKNTNEAMFVIEAYRTLRDRGPYPADQVIKDLEGSFAFVVYDSKSGTVFTALGSDGGVKLYWGIAADGSVVISDDLEVIKAGCAKSFAPFPKGCMFHSEGGLMSFEHPMNKIKAMPRVDSEGVMCGANFKVDTYSRVNSIPRRGSETNWTQWDDHC

SEQ ID NO: 473 - protein, 255 aa, Lactuca sativa
MLAIFHKAFAHPPEELNSPAAHHCTKKPKLPEETLEEFLSVHPTNTFSMTFGDAAVLAYVKPDRPNSIHQRLFTAFDDIYCLFMGSLNNLCSQIKQYGLSKNTNEAMFVIEAYRTLRDRGPYPADQVIKDLEGSFAFVVYDSKAGTVFTALGSDGGVKLYWGIAADGSVVISDDLEVIKAGCANSFAPFPKGCMFHSEGGLMSFEHPMNKIKAMPRVDSEGVMCGANFKVDTYARVNSIPRRGSETNWTQWDDHC

SEQ ID NO: 474 - protein, 255 aa, Lactuca sativa; identical to SEQ ID NO: 472

SEQ ID NO: 475 - protein, 255 aa, Lactuca sativa
  misc_feature (251)..(251): Xaa can be any naturally occurring amino acid
MLAIFHKAFAHPPEELNSPAAHHCSKQPKLPEETLEEFLSVHPTNTFSMTFGDAAALAYVKPDHPYSIHQRLFTAFDDIYCLFMGSLNNLCSQIKQYGLSKNTNEAMFVIEAYRTLRDRGPYPADQVIKDLEGSFAFVVYDSKSGTVFTALGSDGGVKLYWGIAADGSVVISDDLEVIKAGCAKSFAPFPKGCMFHSEGGLMSFEHPMNKIKAMPRVDSEGVMCGANFKVDTYARVNSIPRRGSETNWTQXDDHC

SEQ ID NO: 476 - protein, 254 aa, Lotus japonicus
MLAIFHKAFAHPPDELNSPASYKGAKKPKVPEETLREFLSHHPDNTFSMSFGEAAVLAYVRPERHFSVRPRLFCAIDDIYCLFLGTLNNLCSLNKQYGLTKGTDEAMFVIEAYKTLRDRGPYPADQVVKGLDGSFAFVVYDSKVGTVFAALGSDGGVKLYWGIAADGSVVISDDLDVIKEGCAKSFAPFPTGCMFHSEGGLMSFEHPMNKLKAMPRVDSEGVMCGANFKVDKYTRVNSIPRVGSQAHWMEWEQH

SEQ ID NO: 477 - protein, 253 aa, Cucumis melo
  misc_feature (36)..(36): Xaa can be any naturally occurring amino acid
  misc_feature (40)..(40): Xaa can be any naturally occurring amino acid
  misc_feature (44)..(44): Xaa can be any naturally occurring amino acid
  misc_feature (228)..(228): Xaa can be any naturally occurring amino acid
MLAIFHQTFAHPPEELKSPASFSGSKAPKLPQETLXDFIXRHPXNTFSVNFGQAAVLAYVSPQSFSVHQRLFCGFDEIYCLFLGSLNNLCALNKQYGLSKGSNEAMFLIEAYRTLRDRGPYPADQVIKDLDGSFAFVVYDSRAGAVFAALGADGGVKLYWGIAADGSVVISDDVDVIKEGCAKSYAPFPTGCMFHSEGGLMSFEHPMNKMKAMPRIDSEGAMCGANFXVDVYTRVNSIPRRGSEANWAEWDTN

SEQ ID NO: 478 - protein, 254 aa, Carica papaya
MLAIFHKTFAHPPEELNSPASQKTSKKPKLPDETLNDFLSHHPHNAFSMTFGQAAVLAYVKSDNPFSLHQRLFCGFDDVYCIFLGALNNLCHLNRQYGLTKNSDEAMFVIEAYRTLRDRGPYPADQVVKDMDGSFAFVVYDSKAGCVFAALGSDGGVKLYWGIAADGSVVISDDLEVIKEGCAKSFAPFPTGFMFHSEGGLMSFEHPTNKIKAMPRIDSEGVLCGANFKVDMYTRVNSIPRRGSEANWTLGDSH

SEQ ID NO: 479 - protein, 255 aa, Prunus persica
MLAIFHKACAHPPEELNSPASHNGSKKPKLPEETLTEFLNHHPHNSFSMGFGRAAVLAYVKPDQPFYSQHQRLFCGFDDIYCLFLGSLNNLCLLNKQYGLTKNTNEAMFVIEAYRTLRDRGPYPADQVVKDLDGSFAFVVYDSKGGNVFAALGSDGGVQLYWGIAADGSVVISDELEVIKEGCAKSFAPFPKGCLFHSEGGLMSFEHPMNKMKPMPRIDSEGAMCGATFNVDKYTRVNSIPRVGSEANWTEWASH

SEQ ID NO: 480 - protein, 255 aa, Arachis hypogaea
MLAIFHKAFANPPDELNSPASYKGSKKPKIPEETLRDFLSLHPNNTCSISFGHAAVLAYVRPDNPFSLNNQRLFCGFDDIYCVFLGSLKNLSYMNKQYGLSKGSNEAMLVIEAYKTLRDRGPYPADQVVKELDGSFAFVVYDSKVGSVFAALGSDGGVKLYWGIAADGSVVISDDLQVIKEGCAKSFAPFPTGCMFHSEGGLMSFEHPMNKLKAMPRIDSEGAMCGANFKVDKFSRVNSIPRVGSQSNWMEWDQH

SEQ ID NO: 481 - protein, 255 aa, Populus trichocarpa
MLAIFHKAFAHPPEELNSPASQNGTKKPKLPEETLNDFLSHHPQKTFSMNFGQAAVLAYAPQDNPFSPQQKLFCGFDGIYCLFSGSLNNLCTLNRQYGLTKGTNEAMFVIEAYKTLRDRGPYPADQVVKDLDGSFAFVIYDSTAGSVFAALGSDGGVKLYWGIAADGSVVISDDLEVIKESCVKSFAPFPTGFMFHSEGGLMSFEHPMNKVRAMPRTDSEGFLCGANFKVDVYTRINSLPRRGSEANWTEWQSHS

SEQ ID NO: 482 - protein, 255 aa, Prunus persica; identical to SEQ ID NO: 479

SEQ ID NO: 483 - protein, 200 aa, Raphanus sativus
MLAIFHEAFAHPPEELNSPASEKCSKQPKLPEETLNDFLSRYPQNTFSMSFGKAAVLAYVRPSTSFSVHQRLFCGFDDIYCLFFGSLNNLCQLNKQYGLTKTTNEAMFVIEAYRTLRDRGPYPADQVVKDLDGSFAFVVYDSKAGSVFTALGSDGGVKLFWGIAADGSVVISDDLDVIKEGCAKSFAPFPTGCMFHSEEG

SEQ ID NO: 484 - protein, 250 aa, Raphanus sativus
MLAIFHEAFAHPPEELNSPASEKCSKQPKLPEETLNDFLSRYPQNTFSMSFGKAAVLAYVRPSTSFSVHQRLFCGFDDIYCLFFGSLNNLCQLNKQYGLTKTTNEAMFVIEAYRTLRDRGPYPADQVVKDLDGSFAFVVYDSKAGSVFTALGSDGGVKLFWGIAADGSVVISDDLDVIKEGCAKSFAPFPTGCMFHSEGGLMSFEHPMNKIKAMPRVDSEGVLCGANFKVDVYTRVNSIPRRGSEANWSL

SEQ ID NO: 485 - protein, 214 aa, Raphanus sativus
DFLSRYPQNTFSMSFGKAAVLAYVRPSTSFSVHQRLFCGFDDIYCLFFGSLNNLCQLNKQYGLTKTTNEAMFVIEAYRTLRDRGPYPADQVVKDLDGSFAFVVYDSKAGSVFTALGSDGGVKLFWGIAADGSVVISDDLDVIKEGCAKSFAPFPTGCMFHSEGGLMSFEHPMNKIKAMPRVDSEGVLCGANFKVDVYTRVNSIPRRGSEANWSL

SEQ ID NO: 486 - protein, 259 aa, Carthamus tinctorius
MLAIFHKAFAHPPEELKSPSSSHHSHKPKLPEETLHEFLSLHPTNTFSMSFGDAAVLAYVKPHHPPPDYSLHHQRLFTAFDDIYCVFMGSLNNLCAQIKQYGLSKNTNEAMFVIEAYRTLRDRGPYPADQVVKDLEGSFAFVVYDSKSGTVFTALGSDGGVKLYWGIAADGSVVISDDLEVIKAGCAKSFAPFPKGCMFHSEGGLMSFEHPMNKIKAMPRVDSEGVMCGANFKVDTYTRVNSIPRRGSEANWTQWDDHY

SEQ ID NO: 487 - protein, 254 aa, Glycine max
MLAIFHKAFAHPPEELNSPASYKGSKKPKVPEETLKDFLSHHPHNTCSMSFGDAAVLAYVRPDQSFSRHQRLFCGIDDIYCLFLGSLNNLSLLNKQYGLSKSTDEAMFVIEAYKTLRDRGPYPADQVVKELDGSFAFVVYDSKVGSVFAALGSDGGVKLYWGIAADGSVVISDDLEVIKEGCAKSFAPFPTGCMFHSEGGLMSFEHPMNKLKAMPRVDSEGAMCGANFKVDKFARVNSIPRVGSQSNWMEWDQH

SEQ ID NO: 488 - protein, 254 aa, Glycine max
MLAIFHKAFAHPPEELNSPASYKGSKKPKVPEETLKDFLSHHPHNTCSMSFGEAAVLAYVRPDQSFSRHQRLFCGIDNIYCLFLGSLNNLSLLNKQYGLSKSTDEAMFVIEAYKTLRDRGPYPADQVVKELDGSFAFVVYDSKVGSVFAALGSDGGVKLYWGIAADGSVVISDDLEVIKEGCAKSFAPFPTGCMFHSEGGLMSFEHPMNKLKAMPRVDSEGAMCGANFKVDKFARVNSIPRVGSQSNWMEWDQH

SEQ ID NO: 489 - protein, 254 aa, Glycine max
MLSIFHKGFAHPPEELKSPASNSGSNKPKIPEETLREFLSHHPHNTFSLSFGHSAVLAYTRPDPPSFVHQRLFCGIDDIYCIFLGSLNNLCSLNKQYGLAKGTNEAMFVIEAYKTLRDRGPYPADQVVKDLDGSFGFVVYDSKVGSVFAALGSDGGIKLYWGIAADESVVISDDLDVMKEGCAKSFAPFPPGCMFHSEGGLMSFEHPMNKLKAMPRIDSEGAICGANFKVDKYARVNSIPRVGSQANWMEWTQH

SEQ ID NO: 490 - protein, 255 aa, Fragaria vesca
  misc_feature (252)..(252): Xaa can be any naturally occurring amino acid
MLAIFHKAFAHPPEELNSPASHHGSKKPKLPEETLEEFLSHHPHNNFSMGFGDAAVLAYVKPDQPYSLKQRLFCGFDDIYCLFLGSLNNLCMLNKQYGLTKNTNEAMFVIEAYRTLRDRGPYPADQVVKDLDGSFAFVVYDSKVGSVFTALGSDGGVQLYWGIAADGSVVISDELHVIKEGCAKSYAPFPKGCFFHSEGGLMSFEHPMNKMKAMPRIDSEGAMCGANFNVDKFTRINSIPRVGSEANWSAEXTSH

SEQ ID NO: 491 - protein, 255 aa, Helianthus annuus
MLAIFHKAFAHPPEELKSPAKHKTQPKLPEETLQEFLSVHPTNTFSMTFGDAAVLAYVKPNLNYSVNQRLFTSFDDIYCLFMGSLNNLCSQIKQYGLSKNTNEAMFVIEAYRTLRDRGPYPADQVIKDLEGSFAFVVYDSKTGTVFTALGSDGGVKLYWGIAADGSVVISDDLEVIKAGCAKSFAPFPKGCMFHSEGGLMSFEHPMNKLKAMPRVDSEGVMCGSNFKVDTYSRVNSIPRRGSEANWTQWDDHYAS

SEQ ID NO: 492 - protein, 255 aa, Helianthus annuus
MLAIFHKAFAHPPEELKSPAKHKTKPKLPEETLQEFLSVHPTNTFSMTFGDAAVLAYVKPNLNYSVNQRLFTAFDDIYCLFMGSLNNLCSQIKQYGLSKNTNEAMFVIEAYRTLRDRGPYPADQVIKDLEGSFAFVVYDSKTGTVFTALGSDGGVKLYWGIAADGSVVISDDLEVIKAGCAKSFAPFPKGCMFHSEGGLMSFEHPMNKLKAMPRVDSEGVMCGANFKVDTYSRVNSIPRRGSEANWTQWDDHYAS

SEQ ID NO: 493 - protein, 254 aa, Juglans hindsii x Juglans regia
MLAIFHKAFAHPPEELNSPASYNGTKKPKLPEETLNDFLSLHPHNTSSMSFADAAVLAYVRPDPPCQLHQRLFCGFEDIYCLFLGSLNNLFSLIKQYGLSKGTNEAMFVIEAYRTLRDRGPYPADQVIKDLDGSFAFVVYDSKTGTVFAALGSDGGVKLYWGIAADGSVVISDDLEVIKAGCAKSFAPFPTGCMFHSEGGLMSFEHPMNKVKAMPRVDSEGAMCGANFKVDKYTRVNSIPRVGSESNWTQWDSR

SEQ ID NO: 494 - protein, 256 aa, Juglans hindsii x Juglans regia
MLAIFHKAFAHPPEELNSPSSYNDSKQPKLPEDTLNDFLSHHPRNTSFMTFGDAAVLAYAGQDPPCPLHQRLFCGFEDIYCLFLGSLNNLFSLNKQYGLSKGSNEAMFVIEAYRTLRDRGPYPADQVIKDLDGSFAFVVYDSKAGTVFAALGSDGGVKLYWGVAADGSVVISDDLEVIKAGCAKSFAPFPTGCIFHSEEGLMSFEHPMNKMKAMPRVDSEGAMCGANFKVDKYTRVNSIPRVGSETNWTHWDSHQT

SEQ ID NO: 495 - protein, 304 aa, Brassica rapa
  misc_feature (124)..(124): Xaa can be any naturally occurring amino acid
MEASTDDEKRPMVDLVKDKNGTDQVLLQNPKGASVKISLHGGQVLSWKTERGDELLFTSAKANSKPPHPVRGGIPICFPQFGTRGSLEQHGFARNKMWLVENDPPALPSFDSTGKAYVDLVLKXSDEDTTRIWPHCFEFHLRVSLGLDGNLTLISRVRNINSKPFSFSIAYHTYFSISDISEVRVEGLETLDYLDNMLDKERFTEQGDALTFESEIDRVYLNSKDVVAVFDHERKRTFLIEKEGLPDVVVWNPWDKKAKALPDLGDEEYKHMLCVDGAAIEKPITLKPGEEWTGKLSLSLVLST

SEQ ID NO: 496 - protein, 254 aa, Brassica napus
MEASSDDEKRPMVDLVKDKNGTDQVLLQNPKGASVKISLHGGQVLSWKTERGDELLFTSAKANSKPPHPVRGGIPICFPQFGTRGSLEQHGFARNKMWLVENDPPALPSFDSTGKAYVDLVLKSSDEDTTRIWPHCFEFDLRVSLGLDGNLTLISRVRNINSKPFSFSIAYHTYFSISDISEVRVEGLETLDYLDNMLDKERFTEQGDALTFESEIDRVYLNSKDVVAVFDHERKRTFLIEKEGLPDVGKILKP

SEQ ID NO: 497 - protein, 304 aa, Raphanus sativus
MEASSDDEKRPMVDLIKDKNGTDQVLLQNPKGASVKISLHGGQVLSWKTERGDELLFTSAKANSKPPHPVRGGIPICFPQFGTRGSLEQHGFARNKMWLVENDPPALPSFDSTGKAYVDLVLKSSDEDTTRIWPYSFEFHLRVSLGLDGNLSLISRVRNINSKPFSFSIAYHTYFSISDISEVRLEGLETLDYLDNLLDKERFTEQGDALTFESEIDRVYLNSKDVVAVFDHERKRTFLIEKEGLPDVVVWNPWDKKAKALPDLGDEEYKQMLCVDGAAIEKPITLKPGEEWTGKLNLSLVLST

SEQ ID NO: 498 - protein, 455 aa, Brassica napus
EFAKSGGQSGGSSAPPAKRGRPFGSTSANSAAAAAAAAAAEAMSPSALLGPSLLVHNSFVVEQNNKRIVLALQSGLKSEVTWALNTLTLLSFKERDDIRRDFTPLAKIPGLLDALLLIIDDWRDIALPKDFTCGTRVRSLGVNSSVSGFGSEFDALASVQPPGSGVGSSPGETLGKKSQHQSSQWWNEEDGLFNLDDEGRAEKQLCAIAASNVIRNFSFMPDNETIMAQHRHCLETVYQCINDHMAEDEELVTNSLETIVNLAHLMDLRIFSSSKQSYIKINEKQAVQAVLGILNSSVKAWNCAAAELLGRLIINPDNEPFISPLIPQIHKRLVDLLSIPAVDAQAAAVGALYNLVEVNMDCRLKLASERWAIDRLLKVIKTPHPVPEVCRKAAMILENLVSEPQNRGLLLAYENAFAELLFQDGKYSDSFARILYELTARSNSRVASARGIWGM

SEQ ID NO: 499 - protein, 361 aa, Brassica napus
  misc_feature (23)..(24): Xaa can be any naturally occurring amino acid
GTRTVLFGLSLSLSALRLSYFLXXLFTVKMSLTELDDGLVRSMAIGAVFSDFGGKIRSVGFHRTDDLLVTSSEDDSLRLFDIANAKQVKVTYHKKHGTDRVCFTHHPSSFICSSLYNLESTGESLRYLSMYDNRILRYFKGHKDRVVSLCMSPINDSFMSGSLDRSVRLWDLRVNACQGILHLRGRPAVAYDQQGLVFAIAMEGGAVKLFDSRCYDKGPFDTFLVGGDTAEVNDIKFSNDGKSMLLTTTNNNIYVLDAYHGEKKCGFSLEPSQGASLEATFTPDGKYVLSGSGDGTLHAWNIENPSEVARWENNIGVVSCLKWAPRRAMFVAASTVLTFWIPNDGEAPAPADHSADQQPPQ

SEQ ID NO: 500 - protein, 338 aa, Ricinus communis
MSLNALDDDTVRSMSIGAVFSDFGGKINSVDFHRKDDLLVTASEDDSVRLYDIATAKLLKTTYHKKHGADRICFTHHPSSVICSSKYNLDSTGESLRYLSMYDNRCLRYFKGHKDRVVSLCMSPINDSFMSASLDHSVRIWDLRVNACQGILHLRGRPTVAYDQQGLVFAVAMEGGAIKLFDSRSYDKGPFDTFLVGGDTAEVCDIKFSNDGKSMLLTTTSNNIYVLDAYGGEKRCGFSLEPSPNTTIEATFTPDGQYVVSGSGDGTLHAWNINMRNEVASWNSHIGVASCFKWAPRRAMFVAASSVLTFWIPNPSKSIGEPRAMETEGVAQPENISQ

SEQ ID NO: 501 - protein, 344 aa, Gossypium hirsutum
KMATKMSLTELDDEIVRSMSIGAVFSDFGGKINSLDFHRKDDLLVTASEDDSVRLYDIANAKLIKTTYHKKHGADRICFTHHPSSVICSSRHNLESTGEALRYLSMYDNRCLRYFKGHKERVVSLCMSPVNDSFMSGSLDHSVRIWDLRVNACQGILRLRGRPTVAYDQQGLVFAVAMEGGAIKLFDSRSYDKGPFDTFLVGGDTAEVCDIKFSNDGKSMLLTTTNNNIYVLDAYGGEKRCGFSLEPSPNTTIEATITPDGQYVISGSGDGTLHAWNINMRNEVAAWNSHIGVAACLKWAPRRAMFVAASTVLTFWIPNNCSKPAAETGSTDAQAGLQFEQVGQ

SEQ ID NO: 502 - protein, 339 aa, Vitis vinifera
MMSLTELDDDTVRSMSIGALFSDFVGKINSLDFHRTDDLLVTASEDDSVRLYDIANAKLLKTTYHKKHGADRICFTHHPSSVICSSRHNLDSTGESLRYLSMYDNRCLRYFKGHKERVVSLCMSPINDSFMSGSLDHSVRIWDLRVNSCQGILRLRGRPTVAYDQQGLVFAVAMEGGAIKLFDSRSYDKGPFDTFFVGGDTAEVCDIKFSNDGKSMLLTTTNNNIYVLDAYGGEKRCGFSLEPSPSTTIEATFTPDGQYVVSGSGDGTLHAWSISMRHEVACWNSNIGVTSCLKWAPRRAMFVAASTVLTFWIPNASKSTADPGNTDPEAGPQSEHISQ

SEQ ID NO: 503 - protein, 365 aa, Populus trichocarpa
RKYQSFFLVQTPSKPDRQTPSISVAMMSLTELDDDTVRSMSIGAVFSDFGGKINSVDFHRKDDLLVTASEDDSVRLYDIASAKLLKTTYHKKHGTDRICFTHHPSSVICSSVYHLDSTGESLRYLSLYDNRCLRYFKGHKDKVVSLCMSPINDSFMSSSLDHSIRIWDLRVNACQGILHLRGRPTVAYDQQGLVFAVAMEGGAIKLFDSRSYDKGPFDTFLVGGDTAEVCDIKFSNDGKSMLLTTTSNNIYVLDAYGGDKRCGFSLEPSPSTTIEATFTPDGQYVVSGSGDGTLHAWNINMQNEVSCWNSHIGIASCLKWAPRRAMFVAASTVLTFWIPDSSKPTVDPRPMDTEGAAPSEHVPQQ

SEQ ID NO: 504 - protein, 366 aa, Raphanus sativus
  misc_feature (64)..(64): Xaa can be any naturally occurring amino acid
DPVDFPNPKLSPERIRSLCLRLSLSGFTVCSVSKMSLTELDDGMVRRMAIGAVFSDFGGKIRSXGFHRTDDLLVTSSEDDSLRLFDIANAKQVKITYHKKHGTDRVCFTHHPSSLICSSLYNLESTGESLRYLSMYDNRILRYFKGHKDRVVSLCMSPINDSFMSGSLDRSVRLWDLRVNACQGILHLRGRPAVAYDQQGLVFAIAMEGGAVKLFDSRCYDKGPFDTFLVGGDTAEVNDIKFSNDGKSMLLTTTNNNIYVLDAYHGEKKCGFSLEASQGTSIEATFTPDGKYVLSGSGDGTLHAWNIENPSEVARWENNIGVVSCLKWAPRRAMFVAASSVLTFWIPNDGEAPAPADLPADQQPPQ

SEQ ID NO: 505 - protein, 334 aa, Glycine max
MTASLTELDDDLVRSMAIGAVFSDFGGMIHSIDFHRKDDLLVTASEDDSVRLYDIANAKLLKSTYHKKHGTDRICFTHHPSSVICSSKYTLESTGESLRYLSMYDNRCLRYFKGHKQRVVSLCMSPINDSFMSGSLDHSVRIWDLRVNACQGILHLRGRPAVAYDQQGLVFAVAMEGGAIKLFDSRSYDKGPFDTFLVGGDTAEVCDIKFSNDGKSMLLTTTNNNIYVLDAYGGEKRCGFSLEPSPGTPIEATFTPDGKYMVAGSGSGTMQVWSIETKNEVACWTSHIGVPSCLKWAPRRAMFAAASSVLTFWIPNNDSKLETQYGGTDAEAGP

SEQ ID NO: 506 - protein, 95 aa, Thellungiella halophila
  misc_feature (89)..(89): Xaa can be any naturally occurring amino acid
MSLTELDDGLVRRMAIGAVFSDFGGKIRSMGFHRTDDLLVTSSEDDSLRLFDIANAKQLKITYHKKHGTDRVCFTHHPSSLICSSLYNXESLENP

SEQ ID NO: 507 - protein, 392 aa, Brassica juncea
LSLSVAVSVAVAIDKAPLVEDGLVINGDFETSPSSGFPDDGIVDGPSEIPSWKSNGTVELINSGQKQGGMILIVPQGRHAVRLGNDAEISQELTVEKGFVYSVTFSAARTCAQLESINVSVASVNADEGDTLASRDVDLQTLYNVQGWDPYAWAFEAEEDHVRLVFKNPGMEDDPTCGPIIDDIAIKKLFTPDKPKDNAVINGDFEEGPWMFRNTSLGVLLPTNLDEETSSLPGWTVESNRAVRFVDSDHFSVPGGKRAVELLSGKEGIISQMVETKADKPYLLSFSLGHAGDKCKEPLAIMAFAGDQAQNFHYMAQANSTFEKVGLNFTAKADRTRVAFYSVYYNTRTDDMSSLCGPVIDDVRVWFSGSKKMGGRFGFAVSVFVLLVIGLV

SEQ ID NO: 508 - protein, 409 aa, Brassica rapa
MAPNNNRCKWSSIFMLLLSLSLAVSVAVATDKAPLVEDGLVINGDFETSPSSGFPDDGVVDGPGEIPSWKSNGTVELINSGQKQGGMILIVPQGRHAVRLGNDAEISQELTVEKGSVYSVTFSAARTCAQLESINVSVASVNANEGDTLASRDVDLQTLYNVQGWDPYAWAFEAEEDHVRLVFKNPGMEDDPTCGPIIDDIAIKKLFTPDKLKDNAVINGDFEEGPWMFRNTSLGVLLPTNLDEETSSLPGWNVESNRAVRFVDSDHFSVPGGKRAVELLSGKEGIISQMVETKADKPYLLSFSLGHAGDKCKEPLAIMAFAGDQAQNFHYMAQANSTFEKVGLNFTAKADRTRVAFYSVYYNTRTDDMSSLCGPVIDDVRVWFAGSKKTGAGFGFGVSVFVLLVIGLV

SEQ ID NO: 509 - protein, 131 aa, Raphanus sativus
  misc_feature (89)..(89): Xaa can be any naturally occurring amino acid
  misc_feature (129)..(130): Xaa can be any naturally occurring amino acid
MILIVPQGRHAVRLGNDAEISQELTVEKGSVYSVTFSAARTCAQLESINVSVASVNANEGDTLASRDVDLQTLYNVQGWDPYAWAFEAXEDHVRLVFKNPGMEDDPTCGPIIDDIAIKKLFTLINPKIXXL

SEQ ID NO: 510 - protein, 305 aa, Raphanus sativus
MQTTWHLHVVSFIGFLSLLRLLYPLLKWFITRFLLTDPGRVKRYGSWALVTGATDGIGRAFAHELAKHGLNLILVSRNPSKLASVSDDFRQEFPQIKIKIIPFDFSSERGYEAIEEGIKDLEVGILINNVGITYPRAMFFHEVDQLTWTKIIRVNLEATTWVTRSLIGPMLHRRRGAIINISSGAAVVVPSHPLYAIYAATKAYVDKLSRSLHVEYKHFGIHVQCQVPLYVATRMVSEVADIDKPSFFVPSPEVYAKAAVEQIGIGSRCSPFWAHSLQWFLAGLLPKNLLDTWRLSIGLRRRSLS

SEQ ID NO: 511 - protein, 243 aa, Brassica rapa
  misc_feature (215)..(215): Xaa can be any naturally occurring amino acid
MADSPNEERDSRSPPPPRKEQPRSRSRSRSRSRSMPRDRSRSRSLPRHVSPSRTRGRSRSRSRGRSEIENPGTTLYVTGLSTRVTEKDLEAYFSKEGKVASCVLVLEPRTRESRGFAFVTMDSVKDAERCIKYLNHSVLEGRYITVERSRRKRPRTPTPGHYLGLKSSRDNDRDSRSSRGRHYDRDDSGHRRSPPRRDLSPRDHGRRSPRDHGRXSRRDRSYSPRGRSPERRSERRYQPRGSR

SEQ ID NO: 512 - protein, 298 aa, Brassica napus
MGVMINHHLLAIVFGILGNAISFLVFLAPVPTFYRIYKKKSTESFQSLPYQVSLFSCMLWLCYALIKQDAFLLITINSFGCVVETIYIAMFFTYATKDKRIAAMKLFLTINVAFFSLILMVTHFAVKRPSLQVSVLGWICVAISVSVFAAPLMIVARVIKTKSVEFMPFTLSFFLTISAVMWFAYGLFLHDICIAIPNVVGFILGMVQMLLYGIYRNPGEKLDTEKKMNPSDQQLKSVVVMSPLGVSEVHPIDVNVTEPVDPFSDAVQHKDPSKVTKEKEPATDDGKCHVETARHESV

SEQ ID NO: 513 - protein, 304 aa, Brassica oleracea
MAHNNRFAIFLTFLYAIAGLSAAALVEEQPLVLKYHNGVLLKGNVTVNLIWYGKFTPIQRSVIVDFIRSLNSKDAASSASPSVASWWKTTEKYKGGSSTLVVGKQLLLENYPLGKSLKNPYLRSLSTKLNGGLRSITVILTAKDVTVEGFCMNRCGSHGTSVSKPRRAANGAAYVWVGNSETMCPGYCAWPFHQPIYGPQTPPLVAPNGDVGVDGMIINLATLLANTVTNPFNNGYYQGPPTAPLEAVSACTGIFGSGSYPGYPGQVLVDKTTGSSYNARGLAGRKYLLPAMWDPQTLTCKTLV

SEQ ID NO: 514 - protein, 304 aa, Brassica rapa
MAYNYRFAFFLTVLTALAGISSAALVKEQPLVLKYHNGALLKGNINVNLVWYGKFTPTQRSVIVDFIRSLNSKEATTSAAPSVASWWKTTEKYKGGASTLVVGKQLLLENYPLGKSLKNPNLRALSTKLNGGLRSITVVLTAKDVSVEGFCMNRCGSHGSSVSTSRRAANGEAYVWVGNAETMCPGYCAWPFHQPIYGPQGPPLVAPNGDVGVDGMIINLATLLANTVTNPFKNGYYQGPPTAPLEAVSACTGMFGSGSYPGYAGLVLVDKTTGSSYNARGLAGRKYLLPAMWDPQTSTCKTLV

SEQ ID NO: 515 - protein, 304 aa, Brassica napus
MAYNYRFAFFLTVLTALAGISSAALVKEQPLVLKYHNGALLKGNINVNLVWYGKFTPTQRSVIVDFIRSLNSKEAATSAAPSVASWWKTTEKYKGGASTLVVGKQLLLENYPLGKSLKNPNLRALSTKLNGGLRSITVVLTAKDVSVEGFCMNRCGSHGSSVSTSRRAANGAAYVWVGNAETMCPGYCAWPFHQPIYGPQGPPLVSPNGDVGVDGMIINLATLLANTVTNPFKNGYYQGPPTAPLEAVSACTGMFGSGSYPGYAGLVLVDKTTGSSYNARGLAGRKYLLPAMWDPQTSTCKTLV

SEQ ID NO: 516 - protein, 304 aa, Brassica napus; identical to SEQ ID NO: 514

SEQ ID NO: 517 - protein, 423 aa, Solanum tuberosum
MAGMCCGVNIAETEATAPVEPSSEAARRRRMGIHQFRFVPTDAAAVSAAASVAVQENGRKRHRIEKVIDNKKRQKLETSVTISLSPPPVAVVVADEQKGKDNEVLDLSESGSQSVEIEPDLPKFGATSVCGRRRDMEDAVAIHPSFCKENSESSSNLHFFGVYDGHGCSHVAMKCKDRMHEIVKNEVEKEETPWKEAMIQSFSLMDKEVVNYSSTLRSSTSGSNCRCELQTPQCDAVGSTAVVAVVTPDKIIVSNCGDSRAVLCRNGVAIPLSVDHKPDRPDELNRIQEAGGRVIYWDGARVLGVLAMSRAIGDNYLKPYVISEPEVTITDRTNEDECLILASDGLWDVVSNETACGVARMCLQSRRPPSPAGSPGNDITVTGAGESSDKACSDASILLTKLALARHSSDNVSVVVVDLRKNV

SEQ ID NO: 518 - protein, 416 aa, Solanum tuberosum
MAGMCCGVNIAETEATAPVEPSSEAARRRRMGIHQFRFVPTDAAAVSAVAVQENGRKRHRIEKVIENKKRQKLETSVTISLSPPPVADEQKGKDIEVLDLSESGSQSVEIEPDLPKFGVTSVCGRRRDMEDAVAIHPSFCKENSENSSNLHFFGVYDGHGCSHVAMKCKDRMHEIVKNEVEKEETPWKEAMIQSFSLMDKEVVNYSSALRSSTSGSNCRCELQTPQCDAVGSTAVVAVVTPDKIIVSNCGDSRAVLCRNGVAIPLSVDHKPDRPDELNRIQEAGGRVIYWDGARVLGVLAMSRAIGDNYLKPYVISEPEVTITDRTNEDECLILASDGLWDVVSNETACGVARMCLQSGRPPSPAGSPGNDITVTGAGENSDKACSDASILLTKLALARHSSDNVSVVVVDLRKNV

SEQ ID NO: 519 - protein, 217 aa, Raphanus sativus
MASPLLPTSTSPDHLPGGSDPQLLSSLRVLVSRVLASARHATSDARPWTELIDRSAFSRPPSLSEAASRVRKNFSYFKSNYITLVAILLAASLLSHPFALILLASPAASWLFLYVFRPSDQPLVIGGRTFSDLETLGMLCLCTVVVMFMTSVGSLLMSTLALGTMAVAVHGAFRAPEDLFLEEQETIGSGLFTFFNQNASNAAAAAIATSAMSRVRA

SEQ ID NO: 520 - protein, 223 aa, Antirrhinum majus
  misc_feature (200)..(200): Xaa can be any naturally occurring amino acid
MTGDLNMDVLQESGWEELRKEARKIEGDLDVKLSSYAKLGARFTQGGFVDAASPTLGSSRSWKSMDVEIQALLEKLLDINDSMSRCAASAAPTTSVTQKLARHRDILHELTQEFRRIKGNINSMREHAELLSSVRDDISEYKTSGSLSPRNQLLRERASIHGSISHIDDVIGQAQATRAVLGSQRALFGDVQGKVKQLGXQFPVIRGLLGSIRREKSRDTLIL

SEQ ID NO: 521 - protein, 239 aa, Malus domestica
  misc_feature (191)..(191): Xaa can be any naturally occurring amino acid
  misc_feature (227)..(227): Xaa can be any naturally occurring amino acid
MTDSNLELQESGWEELRREARKIEGDLDVKLSSYAKLGARFTQGGYVDSGSPPVSSSRSWKSMEMEIESLLEKLLDINDSMSRCAASATPATSVTQKLARHRDILHEFTQEFRRIKGNINSLREHAELLTSVRDDISEYKASGSMSPRMQILRERAAIHGSVSHIDEVISQAQTTRAVLGSQRALFGDVQXKVKNLSDKFPIIRGLLGSIRRRRSRDTLILSAVIAXCTLFLIIYWLSK

SEQ ID NO: 522 - protein, 240 aa, Prunus armeniaca
MTTDSNLELQESGWEELRREARKIEGDLDVKLSSYAKLGARFTQGGYVESGSPSVGTSRSWKSMEMEIQSLLEKLLDINDSMSRCAASATPATSVTQKLARHRDILHEFTQEFRRIKGNINSLREHAELLTSVRDDISEYKASGSMSPRMQILRERAAIHGSVSHIDEVISQAQTTRAVLGSQRALFGDVQGKVKNLSDKFPIIRGLLGSIRRRRSRDTLILAAVIAACTLFLIIYWLSK

SEQ ID NO: 523 - protein, 238 aa, Aquilegia formosa
MDVNLELQEAGWEELRKEARKIEGDLDVKLSSYAKLSGRFTQGGYAETGSPTVGSSRSWKSMEMEIESLLEKLQDTNDSMSRCAASATPAASISQKLARHRDILHEFIQEFRRIKGNISSMREHAELLSSVRDDISESKASGSMSPRMQLLRERAAIHGSVAHIDDVISQAQTTRAVLGSQRTMFGDVQGKVKQLSDKFPIIRGLLGAIKRKRSRDTLILAAVIAACTLFLIIYWLSK

SEQ ID NO: 524 - protein, 206 aa, Brassica oleracea
MTESSWDLQESGWEELRREARKIEGDLDVKLSSYAKLGARSTQGGYVDAGSPRSWKSMEIEIQSSLEKLLDINDSMSRCAASAASTTSVTQKLARHRDILHEYTQEFRRIKGNINSMREHAELLSSVRDDISEYKASGSMSPGVQVLRERASIHGSISHIDDVIGQAQATRAVLGSQRSLFSDVQGKVKNLGDKFPVIRGLLGSIR

SEQ ID NO: 525 - protein, 236 aa, Brassica rapa
MAESSLDLHESGWEELRREARKIEGDLDVKLSSYAKLGARFNQGGYGVDGGSPGGSWKSMEIEIQSSLEKLLDINDSMSRCAASAAPTTSVTQKLARHRDILHEYTQEFRRIKGNISSMREHAELLSSVRDDISEYKASGSMSPGVQVLRERASIHGSISHIDEVIGQAQATRAVLGSQRSLFSDVQGKVKNLGDKFPVIRGLLGSIRRRRSRDTLILSAVIAACTLFIIIYWVSK

SEQ ID NO: 526 - protein, 193 aa, Ocimum basilicum
MDVASPTLGSSRSWKSMEMEIQSLLEKLLDINDSMSRCAASAAPTTSVTQKLARHRDILHEFTQEFRRTKGNINSMREHAELLSSVRDDISEYKASGSVSPRMQLLRERAAIHGSISHIDDVISQAQSTRAVLGSQRALFGDVQGKVKQLGDKFPVIRGLIGSIRKKRSRDTLILSAVIAACTLFLIIYWLSK

SEQ ID NO: 527 - protein, 239 aa, Phaseolus coccineus
MRDPNLELQELGWEELRKEARKIEGDLDVKLSSYAKLGGRFTQTGHVDSGSPPLGSSRSWKSMEMEIQSLLEKLLDINDSMSRCAASAGPATSVTQKLARHRDILHDFTQEFRRIKGNINSMREHAELLSSVRDDITDFKTSGSMSPRMQLLRERAAIHGNISHIDDVISQAQATRAVLGSQRTLFTDVQGKVKGLGDKFPMIRSLLGSIRRRRSRDTLILSAVIAACTLFLIIYWLSK

SEQ ID NO: 528 - protein, 236 aa, Theobroma cacao
MTDPILDLQESGWEELRREARKIEGDLDVKLSSYAKLGARFTQGDTGSPTVGSSRSWKSMEMEIQSLLEKLLDTNDAMSRCAASAAPTTSVTQKLARHRDILHEFTQEFRRIKGNINSMREHAELLSSVRDDISEYKASGSMSPRMQLLRERAAIHGSIAHIDDVINQAQTTRAVLGSQRALFGDVQGKVKLLSDKFPVIRGLLGSIRRRRSRDTLILSAVIAACTLFLIIYWLSK

SEQ ID NO: 529 - protein, 236 aa, Brassica napus
MTESSLDLQESGWEELRREARKIEGDLDVKLSSYAKLGARFNQGGYGVDGGSPGGSWKSMEIEIQSSLEKLLDINDSMSRCAASAAPTTSVTQKLARHRDILHEYTQEFRRIKGNISSMREHAELLSSVRDDISEYKASGSMSPGVQVLRERASIHGSISHIDEVIGQAQATRAVLGSQRSLFSDVQGKVKNLGDKFPVIRGLLGSIRRRRSRDTLILSAVIAACTLFIIIYWVSK

SEQ ID NO: 530 - protein, 234 aa, Brassica napus
MTESSLDLQESGWEELRREARKIEGDLDVKLSSYAKLGARFTQGGYVDAGSPRSWKSMEIEIQSSLEKLLDINDSMSRCAASAASTTSVTQKLARHRDILHEYTQEFRRIKGNINSMREHAELLSSVRDDISEYKASGSMSPGVQVLRERASIHGSISHIDEVIGQAQATRAVLGSQRSLFSDVQGKVKNLGDKFPVIRGLLGSIRRRRSRDTLILSAVIAACTLFLIIYWLSK

SEQ ID NO: 531 - protein, 236 aa, Brassica napus
MTESSLDLQESGWEELRREARKIEGDLDVKLSSYAKLGARFNQGGYGVDGGSPGGSWKSMEIEIQSSLEKLLDINDSMSRCAASAAPTTSVTQKLARHRDILHEYTQEFRRIKGNISSMREHAELLSSVRDDISEYKASGSMSPGVQVLRERASIHGSISHIDEVIGQAQATRAVLGSQRSLFSDVQGKVKILGDKFPVIRGLLGSIRRRRSRDTLILSAVIAACTLFIIIYWLSK

SEQ ID NO: 532 - protein, 64 aa, Cichorium intybus
MDQESGWEELRKEARKIEGDLDVKLSSYAKLGARVTQGGFADTDTPTMGSNLMEVNGDGNTVIT

SEQ ID NO: 533 - protein, 239 aa, Citrus sinensis
  misc_feature (227)..(227): Xaa can be any naturally occurring amino acid
MTDPNLYLQESGWEELRKEARKIEGDLDVKLSSYAKLGARFTQGGYVDTGSPTVGSGRSWKSMEMEIQSLLEKLLDINDAMSRCAASAAPTTSVTQKLARHRDILHEFTQEFRRIKGNINSMREHAELLSSVRDDISEYKASGSMSPRMQILRERAAIHGSITHIDDVISQAQTTRTVLGSQRALFGDVQGKVKVLSDKFPIIRGLLGSIRRRRSRDTLILAAVIAXCTLFLIIYWLSK

SEQ ID NO: 534 - protein, 236 aa, Gossypium hirsutum
MTDTNLDLQESGWEELRKEARKIEGDLDVKLSSYAKLGARFTQGDTGSPTLGSSRSWKSMVIEIQSLLEKLLDINDAMSRCAASAAPTTSVTQKLARHRDILHEFTQEFRRIKGNISSMREQAELLSSVRDDISEFKASEGMSPRMQLLRERAAIHGNIAHIDDVINQAQTTRAVLGSQRALFGDVQGKVKVLSDKFPVIRGLLGSIRRRRSRDTLILSAVIAGCTLFLIIYWLSK

SEQ ID NO: 535 - protein, 237 aa, Gossypium hirsutum
  misc_feature (118)..(119): Xaa can be any naturally occurring amino acid
  misc_feature (231)..(231): Xaa can be any naturally occurring amino acid
MTDPNLDLQESGWEELRREARKIEGDLDVKLSSYAKLGARFTQGDTGSPTVGSSRSWKSMEMEIQSLLEKLLDINDAMSRCAASAASTTSVTQKLARHRDILHEFTQEFRRIKGNINXXREHAELLRSVRDDINEYKASGSMSPRMQLLRERAAIHGSIGHIDDVINQAQTTRAVLGSQRALFGDAQGKVKVLSDKVPVIRGLLGSIRRRRSRDTLILSAELLLVRCSLLXIGSQSD

SEQ ID NO: 536 - protein, 239 aa, Vigna unguiculata
MRDPNLELQESGWEELRKEARKIEGDLDVKLSSYAKLGGRFTQTGHVDGGSPPLGSSRSWKSMEMEIQSLLEKLLDINDSMSRCAASAGPATSVTQKLARHRDILHEFTQEFRRIKGNINSMREHAELLSSVRDDITDFKTSGSMSPRMQLLRERAAIHGNISHIDDVISQAQATRAVLGSQRTLFTDVQGKVKGLGDKFPMIRSLLGSIRRRRSRDTLILSAVIAACTLFLIIYWLSK

SEQ ID NO: 537 - protein, 239 aa, Taraxacum officinale
  misc_feature (218)..(218): Xaa can be any naturally occurring amino acid
MDQESGWEELRKEARKIEGDLDVKLSSYAKLGARVTQGGFADADTPTMGSNRSWKSMEMEIQSLLEKLLDVNDSMSRCAASAAPTTSVTQKLARHRDILHEFSQEFRRIKGNISAMTEHAELLSSVRDDISEYKASGSMSPRMQILRERAAIHGSIAHMDDVITQAQTTRAALGSQRTMFGDVQGKVKQLSDRFPIVRGLIGSIKRKKSRDTLILSAXIAAWYVVSHYILAFKVNKKKI

SEQ ID NO: 538 - protein, 240 aa, Eucalyptus gunnii
  misc_feature (21)..(21): Xaa can be any naturally occurring amino acid
MVGDASLELQEAGWEELRKEXRKIEGDLDVKLNSYAKLGARFSQGGYVDTGSPTVGSSRSWKSMEMEIQSLLEKLLDTNEAMSRCAASATPTTSVTQKLARHRDILHEFTQEFRRIKGNISSMKEHAELLSSVRDDISEYKASGSMSPRVQLLRERASIHGSISHIDDVISQAQTTRAALGSQRGLFGDVQGKVKLLSDKFPVIRGILGSIRRRRSRDTLILSAVIAACTLFLIIYWLSK

SEQ ID NO: 539 - protein, 239 aa, Vitis vinifera
MMDPNLDLQESGWEELRKEARKIEGDLDVKLSSYAKLGARFTQGGYVDTGSPTVSSSRSWKSMEMEIQSLLEKLLDTNDAMSRCAASAAPTTSVTQKLARHRDILHEFTQEFRRIKGNMNSMREHAELLSSVRDDISEYKASGSMSPRMQLLRERAAIHGSISHIDDVISQAQTTRAALNSQRTLFGDFQGKVKLLSDKFPIIRGLLGSIRRRRSRDTLILSAVIAACTLFLIIYWLSK

SEQ ID NO: 540 - protein, 233 aa, Lactuca sativa
MDQESGWEELRKEARKIEGDLDVKLSSYAKLGARVTQGGFADAETPTMGSNRSWKSMEMEIQSLLEKLLDVNDSMSRCAASAAPTTSVTQKLARHRDILHEFSQEFRRIKGNISAMTEHAELLSSVRDDISEYKASGSMSPRMQILRERAAIHGSISHMDDVITQAQTTRAALGSQRAMFGDVQGKVKQLSDKFPIVRGLIGSIRRKKSRDTLILSAVIAACTLFLIIYWLSK

SEQ ID NO: 541 - protein, 239 aa, Cucumis melo
  misc_feature (83)..(83): Xaa can be any naturally occurring amino acid
  misc_feature (150)..(150): Xaa can be any naturally occurring amino acid
MTDQSLELQESGWEELRREARKIEGDLDVKLSSYAKLGTRFTQGGYVDSGSSSVGSNRSWKSMEMEIQSLLEKLLDVNDSMSXCAASATPATSINQKLARHRDILHEFTQEFKRIKGNINSMREHAELLSSVRDDINEYKSPGTMSPRVXLLRERAAIHGSIAHMDEVISQAQTTRAVLGNQRVLFGDVQGKVKLLSDKFPVIRGLLGSIRRRRSRDTIILSGVIAACTLFLIIYWLSK

SEQ ID NO: 542 - protein, 240 aa, Populus trichocarpa
MTDPNLELQESGWEELRREARKIEGDLDVKLSSYAKLGARFTTQGGGYVEGGSPRVGSSRSWKSMEMEIQSSLEKLLDINDAMSRCAAASAATSVTQKLARHRDILHEFTQEFRRIKGNINSMREHAELLSSVRDDISEYKASGSMSPRVHLLRERAAIHGSIAHIDDVINQAQTTRAVLGSQRTFFGDVQGKVKVLSDKFPIIRGLLGSIRRRRSRDTLILSAVIAACTLFLIIYWLSK

SEQ ID NO: 543 - protein, 243 aa, Populus trichocarpa
MTDTNLELQESGWEELRREARKIEGDLDVKLSSYAKLGSRFTQGGGGGGYVETGSPTVGSSRSWKSMEMEIQSSLEKLLDINDAMSRCAASAAPATSVTQKLARHRDILHDFTQEFRRIKGNINSMREHSELLSSVRDDISEYKASGSMSPRVQLLRERAAIHGSISHIDDVINQAQTTRAVLGSQRAFFGDVQGKVKLLGDKFPIIRGLLGSIRRRRSRDTLILSAVIAACTLFLIIYWLSK

SEQ ID NO: 544 - protein, 241 aa, Solanum tuberosum
MSKDLSMEILQESGWEELRKEARKIEGDLDVKLSSYAKLGARVTQGGYVEAGSPTLGSSRSWKSTEMEIQSLLEKLLDVNDSMSRCAASAASTTSVTQKLARHRDILHEFTQEFRRIKGNISSMREHAELLSSVRDDISEYKASGSMSPKMHILRERAALHGSISHIDDVINQAQTTRAALGSQRALFGDVQGKVKQLGDKFPVIRGLIGSIRRKKSRDTLILSAVIAACTLFLIIYWLSK

SEQ ID NO: 545 - protein, 240 aa, Prunus persica; identical to SEQ ID NO: 522

SEQ ID NO: 546 - protein, 236 aa, Raphanus sativus
MTEASLDLQESGWEELRREARKIEGDLDVKLSSYAKLGARFNQGGYGVEGGSPGGSWKSMEIEIQSSLEKLLDINDSMSRCAASAAPTTSVTQKLARHRDILHEYTQEFRRIKGNINSMREHAELLSSVRDDISEYKASGSMSPGVQVLRERASIHGSISHIDEVIGQAQATRAVLGSQRSLFSDVQGKVKNLGDKFPVIRGLLGSIRRRRSRDTLILSAVIAACTLFIIIYWLSK

SEQ ID NO: 547 - protein, 236 aa, Raphanus sativus
  misc_feature (86)..(86): Xaa can be any naturally occurring amino acid
MTEASLDLQESGWEELRREARKIEGDLDVKLPSYAKLGARFNQGGYGVEGGSPGGSWKSMEIEIQSSLEKLLDINDSMSRCAASAXPTTSVTQKLARHRDILHEYTQEFRRIKGNINSMREHAELLSSVRDDISEYKASGSMSPGVQVLRERASIHGSISHIDEVIGQAQATRAVLGSQRSLFSDVQGKVKNLGDKFPVIRGLLGSIRRRRSRDTLILSAVIAACTLFIIIYWLSK

SEQ ID NO: 548 - protein, 217 aa, Carthamus tinctorius
  misc_feature (212)..(212): Xaa can be any naturally occurring amino acid
MDQESGWEELRKEARKIEGDLDVKLSSYAKLGARVTQGGYADADTPTIGSNRSWKSMEMEIQSLLEKLLDVNDSMSRCAASAAPTTSVTQKLARHRDILHEFSQEFRRIKGNISAMTEHAELLSSVRDDISEYKASGSMSPRMQILRERAAIHGSIAHMDDVISQAQTTRAALGSQRAMFGDVQGKVKQLSDKFPIVRGLIGSIRRKKSGIXSSYLL

SEQ ID NO: 549 - protein, 239 aa, Glycine max
MRDPNLELQESGWEELRKEARKIEGDLDVKLSSYAKLGARFTQGGYVDSGSPPIGSSRSWKSMEMEIQSLLEKLLDINDSMSRCAASAGPATSVTQKLARHRDILHEFTQEFRRIKGNINSMREHAELLSSVRDDITDFKTSGSMSPRMQLLRERAAIHGSISHIDDVISQAQATRAVLGSQRTLFTDVQGKVKVLGDKFPMIRSLLGSIRRRRSRDTLILSAVIAACTLFLIIYWLSK

SEQ ID NO: 550 - protein, 241 aa, Glycine max
MRDTNLELQESGWEELRKEARKIEGDLDVKLSSYAKLGARFTQGGSGYVDSGSPPIGSSRSWKSMEMEIQSLLEKLLDINDSMSRCAASAGPATSVTQKLARHRDILHEFTQEFRRIKGNINSMREHAELLSSVRDDITDFKTSGSMSPRMQLLRERASIHGNISHIDDVISQAQATRAVLGSQRTLFTDVQGKVKVLGDKFPMIRSLLGSIRRRRSRDTLILSAVIAACTLFLIIYWLSK

SEQ ID NO: 551 - protein, 239 aa, Euphorbia esula
MTDQSLELQESGWEELRKEARKAEGDLDVKLSSYAKLGARFTQGGYVDAGSPTVGGSRSWKSMEMEIQSLLEKLLDINDSMSRCAASASPTTSVTQKLARHRDILHEFTQEFRRIKGNISSMREHAELLSSVRDDISEYKASGSSSPRMQLLRERAGIHGSIAHIDDVINQAQSTRAVLGSQRAFFGDVQGKVKLLSDKFPVIRGLLGSIRRRRSRDTLILSAVIAACTLFLIIYWLSK

SEQ ID NO: 552 - protein, 237 aa, Helianthus annuus
MDQESGWEELRKEARKIEGDLDVKLSSYAKLGARVTQGGFADPDTPSMGSNRSWKSMEMEIQSLLEKLLDVNDSMSRCAASAAPTTSVTQKLARHRDILHEFSQEFRRIKGNISAMTEHAELLSSVRDDISEYKASGSPRMQILRERAAIHGSIAHMDDVITQAQTTRAALGTQRAMFGDVQGKVKQLSDKFPIVRGLIGSIRRKKSRDTLILSAVIAACTLFLIIYWLSSEEDYVI

SEQ ID NO: 553 - protein, 118 aa, Thellungiella halophila
MTESSLDLQESGWEELRREARKIEGDLDVKLSSYAKLGARFTQGGYVDAGSPTVGSGRSWKSMEMEIQSLLEKLLDINDSMSRCAASAAPTTSVTQKLARHRDILHEYTQDFRRIKGK

SEQ ID NO: 554 - protein, 241 aa, Nicotiana tabacum
MSKDPSMEILLQESGWEELRKDARKIEGDLDVKLSSYAKLGARLTQGGYVEAGSPTLGSSRSWKSMEMEIQSLLEKLLVVNDSMSRCAASAAPTTSVTQKLARHRDILHEFTQEFRRIKGNISSMREHAELLSSVRDDISEYKASGSSPKMQILRERAAIHGSISHIDDVINQAQTTRAALGSQRALFGDVQGKVKQLGDKFPIIRGLIGSIRRKKSRDTLILSAVIVACTLFLIIYWLSK

SEQ ID NO: 555 - protein, 241 aa, Solanum lycopersicum
MSKDLSMEILQESGWEELRKEARKIEGDLDVKLSSYAKLGARVTQGGYVEAGSPTLGSSRSWKSTEMEIQSLLEKLLDVNDSMSRCAASAASTTSVTQKLARHRDILHEFTQEFRRIKGNISSMREHAELLSSVRDDISEYKASGSMSPKMHILRERAAIHGSISHIDDVINQAQTTRAALGSQRALFGDVQGKVKQLGDKFPVIRGLIGSIRRKKSRDTLILSAVIAACTLFLIIYWLSK

SEQ ID NO: 556 - protein, 241 aa, Triphysaria pusilla
MSGDPSMDALQESGWEELRKEARKIEGDLDFKLSSYAKLGARFNHGGNVDAGSPTLGSSRSWKSIEMEIQSLLEKLLDINDSMSRCAASAASTTSVSQKLARHRDILHEFTQEFKRTQGNINSMWEHAELISSVRDDITDYKASGSVNPSTQLLRERAAIHGSISHIDDVISQAQATRSVLGSQRALFGDVQGKVKQLGEKFPVIRGLIGSIKRKRSKDTLILSAVIAACTLFLIIYWLSK

SEQ ID NO: 557 - protein, 484 aa, Malus domestica
MAISTAAAAAATSASSKLAYPYASTASPSPTTSSFSIRPSSKLTHLSSSFLNPSTILHLTPASNTRHHRRNFTVKAARGKFERKKPHVNIGTIGHVDHGKTTLTAALTMALASIGNSVSKKYDEIDAAPEERARGITINTATVEYETENRHYAHVDCPGHADYVKNMITGAAQMDGAILVVSGADGPMPQTKEHILLAKQVGVPNMVVFLNKQDQVDDEELLQLVELEVRELLSSYEFPGDDVPIISGSALLALEALMANPTISRGENQWVDKIYELMDSVDDYIPIPQRQTELPFLMAIEDVFSITGRGTVATGRVERGKVKVGDTVDIVGLKDTRNTTVTGVEMFQKILDDAMAGDNVGLLLRGIQKIDIQRGMVLAKPGTITPHTKFEAIVYVLKKEEGGRHSPFFSGYRPQFYMRTTDVTGKVTSIMNDKDEESKMVMPGDRVKIVVELIVPVACEQGMRFAIREGGKTVGAGVIQSIIE

SEQ ID NO: 558 - protein, 487 aa, Malus domestica
MAISTLAATAATSASSKLTYPYASPASPSPTTPSFSIRPSSKLTHLSSSFLNPSTILHLTPSTATPHHHHRRRNFTVKAARGKFERKKPHVNIGTIGHVDHGKTTLTAALTMALASIGNSVSKKYDEIDAAPEERARGITINTATVEYETENRHYAHVDCPGHADYVKNMITGAAQMDGAILVVSGADGPMPQTKEHILLAKQVGVPNMVVFLNKQDQVDDEELLQLVELEVRELLSSYEFPGDDVPIISGSALLALEALMANPTISRGENQWVDKIYELMDAVDDYIPIPQRQTELPFLMAIEDVFSITGRGTVATGRVERGKVKVGDTVDIVGLKDTRNTTVTGVEMFQKILDDAMAGDNVGLLLRGIQKIDIQRGMVLAKPGTITPHTKFEAIVYVLKKEEGGRHSPFFSGYRPQFYMRTTDVTGKVTSIMNDKDEESKMVMPGDRVKIVVELIVPVACEQGMRFAIREGGKTVGAGVIQSIIE

SEQ ID NO: 559 - protein, 483 aa, Aquilegia formosa
MAIASSSSIVSSSKLLFTPNSSSSSSTHSITPFNRISKSTPLLSSSFANPSSIFWLSNSTPTTETRRSRSLTVRAARGKFERKKPHVNIGTIGHVDHGKTTLTAALTMALASMGTTAPKKYDEIDAAPEERARGITINTATVEYETENRHYAHVDCPGHADYVKNMITGAAQMDGAILVVSGADGPMPQTKEHILLAKQVGVPNMVVFLNKQDQVDDAELLELVELEVRELLSSYEFPGDDVPIVSGSALLALEALIANPKIKRGENEWVDKIYQLMDSVDEYIPIPQRQTELPFLLAVEDVFSITGRGTVATGRVERGTVRVGETIDLVGLRDTRSTTVTGVEMFQKILDEALAGDNVGLLLRGIQKADIQRGMVLAKPGSITPHTKFEAIVYVLKKEEGGRHSPFFAGYRPQFYMRTTDVTGKVYSIMNDKDEESKMVMPGDRVKMVVELIMPVACEQGMRFAIREGGKTVGAGVIQAIIE

SEQ ID NO: 560 - protein, 479 aa, Phaseolus coccineus
  misc_feature (304)..(304): Xaa can be any naturally occurring amino acid
MAISSAAAGATSKLAYPHVYPSSSPSSNSLFLKTHAPSTTHLSSSFIHPSTVLHLAPTPAALRRRSFTVRAARGKFERKKPHVNIGTIGHVDHGKTTLTAALTMALASLGNSAPKKYDEIDAAPEERARGITINTATVEYETENRHYAHVDCPGHADYVKNMITGAAQMDGAILVVSGADGPMPQTKEHILLAKQVGVPNIVVFLNKQDQVDDEELLQLVELEVRELLSSYEFPGDDVPIVSGSALLALEALMANPSIKRGENQWVDKIYELMEAVDNYIPIPQRQTELPFLLAIEDVFTITGXGTVATGRVERGTIKVGETVDIVGVRETRNTTVTGVEMFQKILDEALAGDNVGLLLRGIQKMDIQRGMVLSKPGSITPHTKFSAIVYVLKKEEGGRHSPFFAGYRPQFYMRTTDVTGKVTSIMNDKDEESKMVMPGDRVKMIVELIVPVACEQGMRFAIREGGKTVGAGVIQSIIE

SEQ ID NO: 561 - protein, 488 aa, Phaseolus coccineus
MALSSATASSKLILFPHASSSSPSSSSSPSSSSLNSTPFRSTTTTTHKLTPLSSSFLHPTTILRRTPSTTTHRRQFTVRAARGKFERKKPHVNIGTIGHVDHGKTTLTAALTMALAALGNSAPKKYDEIDAAPEERARGITINTATVEYETENRHYAHVDCPGHADYVKNMITGAAQMDGAILVVSGADGPMPQTKEHILLAKQVGVPNVVVFLNKQDQVDDEELLQLVDLEVRELLSSYEFPGDDIPIISGSALLALEALMENPGIKRGDNEWVDKIYKLMDEVDSYIPIPQRQTDLPFLLAVEDVFTITGRGTVATGRVERGTIKVGETVDLVGLRETRNTTVTGVEMFQKILDEALAGDNVGLLLRGIQKMDIQRGMVLAKPGSITPHTKFEAIVYVLKKEEGGRHSPFFPGYRPQFYMRTTDVTGKVTSIMNDKDEESKMVMPGDRVKIIVELIVPVACEQGMRFAIREGGKTVGAGVIQSIIE

SEQ ID NO: 562 - protein, 454 aa, Brassica napus
LPRRHFHLHQTQSPKPLLLLPPSTIIYHSILHSSPNPLRRSFTVRAARGKFERKKPHVNIGTIGHVDHGKTTLTAALTMALASMGNSVAKKYDEIDAAPEERARGITINTATVEYETENRHYAHVDCPGHADYVKNMITGAAQMDGAILVVSGADGPMPQTKEHILLAKQVGVPDMVVFLNKEDQVDDAELLELVELEVRELLSSYEFNGDDIPIISGSALLAVETLTENPNVKRGDNKWVDKIYELMDAVDSYIPIPQRQTELPFLLAVEDVFSITGRGTVATGRVERGTVKVGETVDLVGLRETRNYTVTGVEMFQKILDEALAGDNVGLLLRGIQKADIQRGMVLAKPGSITPHTKFEAIVYVLKKEEGGRHSPFFAGYRPQFYMRTTDVTGKVTKIMNDKDEESKMVMPGDRVKIVVELIVPVACEQGMRFAIREGGKTVGAGVIQSIIE

SEQ ID NO: 563 - protein, 474 aa, Brassica napus
MAFSSPAATSSSTRLLYSPYAASPSSSPSPTISLTLSSSFLPSLTSLSVATSSPHPLRRAAFTVRAARGKFERKKPHVNIGTIGHVDHGKTTLTAALTMALASMGNSVAKKYDEIDAAPEERARGITINTATVEYETENRHYAHVDCPGHADYVKNMITGAAQMDGAILVVSGADGPMPQTKEHILLAKQVGVPDMVVFLNKEDQVDDAELLELVELEVRELLSSYEFNGDDIPIISGSALLAVETLTANPNVKRGENKWVDKIYELMDSVDSYIPIPTRQTDLPFLLAVEDVFSITGRGTVATGRVERGTVKVGETVDLVGLRETRNYTVTGVEMFQKILDEAMAGDNVGLLLRGIQKADIQRGMVLAKPGSITPHTKFEAIVYVLKKEEGGRHSPFFAGYRPQFYMRTTDVTGKVTKIMNDKDEESKMVMPGDRVKIVVELIVPVACEQGMRFAIREGGKTVGAGVIQTILE

SEQ ID NO: 564 - protein, 483 aa, Citrus sinensis
MAISASAAATVASTSPKLTHPYASASPSNSLPSTTALRTKLTPSNLSSSFLPPFATTTTAVTVTTTRRRSLIVRAARGKFERKKPHVNIGTIGHVDHGKTTLTAALTMALASLGNSAPKKYDEIDAAPEERARGITINTATVEYETENRHYAHVDCPGHADYVKNMITGAAQMDGAILVVSGADGPMPQTKEHILLAKQVGVPNMVVFLNKQDQVDDEELLQLVELEVRELLSSYEFPGDDVPIISGSALLALEALMANPSIKRGENQWVDKIYELMDSVDSYIPIPQRQTDLPFLLAVEDVFSITGRGTVATGRVERGTIKVGETVDLVGLKETRNFTVTGVEMFQKTLDEAMAGDNVGLLLRGVQKADIQRGMVLAKPGTITPHTKFLAIVYVLKKEEGGRHSPFFAGYRPQFYMRTTDVTGRVSSIMNDKDEESKMVMPGDRVKMVVELIMPVACEQGMRFAIREGGKTVGAGVIQSIIE

SEQ ID NO: 565 - protein, 486 aa, Trifolium pratense
MAISISSSSTSSKLKLTPSHSPNSHTFIAASASTRSTTNPPKLTLTRLTSSFLNPSTILHLTPTSHYSNHQRRFTVRAARGKFERKKPHLNIGTIGHVDHGKTTLTAALTMALASLGNSAPKKYDEIDAAPEERARGITINTATVEYETETRHYAHVDCPGHADYVKNMITGAAQMDGAILVVSGADGPMPQTKEHILLAKQVGVPSVVVFLNKQDQVDDEELLELVDLEVRELLSSYEFPGDDIPIVSGSALLALEALMANPTLKRGDNKWVDKIYQLMDEVDKYIPIPQRQTDLPFLLAVEDVFSITGRGTVATGRIERGTVKVGDVVDLVGLRNTRSTTVTGVEMFQKILDDAMAGDNVGLLLRGVQKDDIERGMVLAKPGTITPHSKFSAIVYVLKKEEGGRHSPFFAGYRPQFYMRTTDVTGKVTSIMNDKDEESKMVMPGDRVKMVVELIVPVAIEQGMRFAIREGGKTVGAGVIGAIIV

SEQ ID NO: 566 - protein, 485 aa, Gossypium hirsutum
MAISSTAAATAASSKLRYPHASPFPTHSSTTTSAFFSSIPSKLTPTHLSSSFLPPFLTTVATTSVFPRRRGSFTVKAARGKFERKKPHVNIGTIGHVDHGKTTLTAALTMALASMGNSAPKKYDEIDAAPEERARGITINTATVEYETENRHYAHVDCPGHADYVKNMITGAAQMDGAILVVSGADGPMPQTKEHILLAKQVGVPNVVVFLNKQDQVDDEELLQLVELEVRELLSSYEFPGDDVPIISGSALLALEALMAKPSIPRGENQWVDKIYELMDAVDSYIPVPQRQTDLPFLLAVEDVFSITGRGTVATGRIERGTVKVGETVDIVGLKDTRNVTVTGVEMFQKTLDDAMAGDNVGLLLRGVQKADIQRGMVLAKPGTITPHTKFSAIVYVLKKEEGGRHSPFFAGYRPQFYMRTTDVTGRVASIMNDKDEESKMVMPGDRVKMVVELIMPVACEQGMRFAIREGGKTVGAGVIQSIIE

SEQ ID NO: 567 - protein, 480 aa, Vigna unguiculata
MAISSAAAAAATSKLAYPHVYPSPSPSSNSLFLKSHTPSTTHLSSSFIHPSTVLHLAPVPAALRRRSFTVRAARGKFERKKPHVNIGTIGHVDHGKTTLTAALTMALASLGNSAPKKYDEIDAAPEERARGITINTATVEYETENRHYAHVDCPGHADYVKNMITGAAQMDGAILVVSGADGPMPQTKEHILLAKQVGVPNIVVFLNKQDQVDDEELLQLVELEVRELLSSYEFPGDDVPIVSGSALLALEALMANPSIKRGENQWVDKIYELMEAVDNYIPIPQRQTELPFLLAIEDVFTITGRGTVATGRVERGTIKVGETVDIVGVKETRNTTVTGVEMFQKILDEALAGDNVGLLLRGIQKTDIQRGMVLSKPGTITPHTKFSAIVYVLKKEEGGRHSPFFAGYRPQFYMRTTDVTGKVTSIMNDKDEESKMVMPGDRVKMVVELIVPVACEQGMRFAIREGGKTVGAGVIQSIIE

SEQ ID NO: 568 - protein, 484 aa, Vigna unguiculata
MALSSATASSKLILFPHASSSSSSSPTSLNSTPFRSTTTTTTHKPTTLSSSFLQPSTILRRTPSTTTHRRQFTVRAARGKFERKKPHVNIGTIGHVDHGKTTLTAALTMALAALGNSAPKKYDEIDAAPEERARGITINTATVEYETENRHYAHVDCPGHADYVKNMITGAAQMDGAILVVSGADGPMPQTKEHILLAKQVGVPNMVVFLNKQDQVDDEELLQLVELEVRELLSSYEFPGDDIPIVSGSALLALEALMENPAIKRGDNEWVDKIYQLMDEVDNYIPIPQRQTELPFLLAVEDVFTITGRGTVATGRVERGTIKVGDTVDLVGLRETRNTTVTGVEMFQKILDEALAGDNVGLLLRGIQKMDIQRGMVLAKPGTITPHTKFEAIVYVLKKEEGGRHSPFFAGYRPQFYMRTTDVTGKVTGIMNDKDEESKMVMPGDRVKMVVELIVPVACEQGMRFAIREGGKTVGAGVIQSIIE

SEQ ID NO: 569 - protein, 433 aa, Vitis vinifera
PSTTFLLTPTTTATTTQRRSFTVRAARGKFERNKPHLNIGTIGHVDHGKTTLTAALTMALAAMGNSAPKKYDEIDAAPEERARGITINTATVEYETENRHYAHVDCPGHADYVKNMITGAAQMDGAILVVSGADGPMPQTKEHILLAKQVGVPNMVVFLNKQDQVDDEELLQLVELEVRELLSSYEFPGDDVPIISGSALLALEALMANPSIKRGENQWVDKIYELMDSVDSYIPIPQRQTDLPFLLAIEDVFSITGRGTVATGRVERGTIKVGETVDIVGLKDTRSTTVTGVEMFQKILDEALAGDNVGILLRGVQKADIQRGMVLAKPGTITPHTKFAAIVYVLKKEEGGRHSPFFAGYRPQFYMRTTDVTGKVTSIMNDKDEESKMVMPGDRVKMVVELIMPVACEQGMRFAIREGGKTVGAGVIQSIIE

SEQ ID NO: 570 - protein, 487 aa, Vitis vinifera
MASIVGAPSTPSKSLFTSPSLSNPKPTSFFHKTQTLATKSNPPFASSFTNASSIFRYSVLSSPSTGSSPFRRRSLTVRAARGKFERKKPHVNIGTIGHVDHGKTTLTAALTMALASMGNSAPKKYDEIDAAPEERARGITINTATVEYETESRHYAHVDCPGHADYVKNMITGAAQMDGAILVVSGADGPMPQTKEHILLAKQVGVPNMVVFLNKQDQVDDEELLQLVELEVRELLASYEFPGDDIPIVSGSALLALEALMANPSIKRGENEWVDKIYELMDAVDSYIPIPQRQTDLPFLLAVEDVFSITGRGTVATGRVERGTIKVGETVDLVGLRETRATTVTGVEMFQKILDEALAGDNVGLLLRGIQKADIQRGMVLAKPGTITPHTKFSAIVYILKKEEGGRHSPFFAGYRPQFYMRTTDVTGKVAQIMNDKDEESKMVMPGDRVKMVVELIMPVACEQGMRFAIREGGKTVGAGVIQSIIE

SEQ ID NO: 571 - protein, 484 aa, Lactuca sativa
MASISAAATAAASFTYATPSSSSSSSCPLFTLQKPTTRILLSSSFVSKASTNLFLHNPSSSSANTSHRLRSLTVRAARGKFERTKPHVNIGTIGHVDHGKTTLTAALTMALASTGGGIGKKYDEIDAAPEERARGITINTATVEYETENRHYAHVDCPGHADYVKNMITGAAQMDGAILVVSGADGPMPQTKEHVLLAKQVGVPNMVVFLNKQDQVDDEELLELVELEVRELLSSYEFPGDDIPIISGSALLALEALTENPKIAKGQNKWVDKIYELMAAVDDYIPIPQRQTDLPFLCAIEDVFSITGRGTVATGRVERGTVRVGESVEIVGLKDTRTTIVTGVEMFQKILDEALAGDNVGLLLRGVQKIDIQRGMVLAKPGSITPHTKFEALVYVLKKEEGGRHSPFFAGYRPQFYMRTTDVTGKVTSIMNDKDEESKMVMPGDRVKMVVELIMPVACEQGMRFAIREGGKTVGAGVIGNIIE

SEQ ID NO: 572 - protein, 484 aa, Lactuca sativa
MASISAAATAAASFTYATPSSSSSSSSPLFTLQKPTTRILLSSSFVSKSSTNLFLHNPSSSSANASHRRRSLTVRAARGKFERTKPHVNIGTIGHVDHGKTTLTAALTMALASTGGGIGKKYDEIDAAPEERARGITINTATVEYETENRHYAHVDCPGHADYVKNMITGAAQMDGAILVVSGADGPMPQTKEHVLLAKQVGVPNMVVFLNKQDQVDDEELLELVELEVRELLSSYEFPGDDIPIISGSALLALEALTENPKIAKGQNKWVDKIYELMAAVDDYIPIPQRQTDLPFLCAIEDVFSITGRGTVATGRVERGTVRVGESVEIVGLKDTRTTIVTGVEMFQKILDEALAGDNVGLLLRGVQKIDIQRGMVLAKPGSITPHTKFEALVYVLKKEEGGRHSPFFAGYRPQFYMRTTDVTGKVTSIMNDKDEESKMVMPGDRVKMVVELIMPVACEQGMRFAIREGGKTVGAGVIGNILE

SEQ ID NO: 573 - protein, 536 aa, Medicago truncatula
FHFDKKRFSFLLHPHNTNSSLISTSIHSKTKREDNKTNPLLFTLNSTMAISISSSSSTKLKLSSPYPPHTHTFTTSSSASISNPSTTHRPKLTLTHLSSSFLNPSTILHLTPSSKPTPTRSSPFTVRAARGKFERKKPHLNIGTIGHVDHGKTTLTAALTMALASLGNSAPKKYDEIDAAPEERARGITINTATVEYETETRHYAHVDCPGHADYVKNMITGAAQMDGAILVVSGADGPMPQTKEHILLAKQVGVPSVVVFLNKQDQVDDEELLELVELEVRELLSSYEFPGDDIPIVSGSALLALEALVANPTIKRGDNEWVDKIYKLMDEVDNYIPIPQRQTELPFLLAIEDVFSITGRGTVATGRIERGLVKVGDVVDLVGLRETRSTTVTGVEMFQKILDDAMAGDNVGLLLRGVQKIDIQRGMVLAKPGTITPHSKFECIVYVLKKEEGGRHSPFFAGYRPQFYMRTTDVTGKVTSIMNDKDEESKMVMPGDRVKMVVELIVPVAIEQGMRFAIREGGKTVGAGVIGAIIE

SEQ ID NO: 574 - protein, 483 aa, Populus trichocarpa
MAVSASATTFTSTNLIYPHHTTTTSSTSTPTFSLKPTSKLPSKSILSSSFLSPFTPTSPTSPFTTTRHRTFTVRAARGKFERKKPHVNIGTIGHVDHGKTTLTAALTMALASMGGSAPKKYDEIDAAPEERARGITINTATVEYETESRHYAHVDCPGHADYVKNMITGAAQMDGAILVVSGADGPMPQTKEHILLAKQVGVPNMVVFLNKQDQVDDEELLQLVELEVRELLSSYEFPGDDIPIISGSALLALEALMENPAIKRGENQWVDKIYELMDNVDNYIPIPQRQTDLPFLLAVEDVFSITGRGTVATGRVERGTIKTGDTVDIVGLRETRNTTVTGVEMFQKILDEALAGDNVGLLLRGVQKADIQRGMVLSKPGSITPHTKFEAIVYVLKKEEGGRHSPFFAGYRPQFYMRTTDVTGRVATIMNDKDEESKMVMPGDRVKMIVELIMPVACEQGMRFAIREGGKTVGAGVIQAIIE

SEQ ID NO: 575 - protein, 514 aa, Populus trichocarpa
PIKREQNTSSHTFLSQSRKLSPLSLSNPPLLMAISASTTTFTSTNLLYPHHSTTTSTTSTPTFSLTPTSKLPSKSILSSSFLPTLTPTSSSSPLTTTRHRFLTVRAARGKFERKKPHVNIGTIGHVDHGKTTLTAALTMALASMGGSAPKKYDEIDAAPEERARGITINTATVEYETESRHYAHVDCPGHADYVKNMITGAAQMDGAILVVSGADGPMPQTKEHILLAKQVGVPNMVVFLNKQDQVDDEELLQLVELEVRELLSSYEFPGDDIPIISGSALLALEALMENPAIKRGENQWVDKIYELMDNVDNYIPIPQRQTDLPFLLAVEDVFSITGRGTVATGRVERGTIKTGDTVDIVGLRETRNVTVTGVEMFQKILDEALAGDNVGLLLRGVQKADIQRGMVLSKPGSITPHTKFEAIVYVLKKEEGGRHSPFFAGYRPQFYMRTTDVTGRVATIMNDKDEESKMVMPGDRVKMVVELIMPVACEQGMRFAIREGGKTVGAGVIQSIIE

SEQ ID NO: 576 - protein, 315 aa, Solanum tuberosum
MASISAASATATSSTKLLNPSNPLLPSATKPSKLILSSSFTPNFSTLFLHSPAATSPTTHHQRRFTVRAARGKFERKKPHVNIGTIGHVDHGKTTLTAALTMALASMGNSAPKKYDEIDAAPEERARGITINTATVEYETENRHYAHVDCPGHADYVKNMITGAAQMDGAILVVSGADGPMPQTKEHILLAKQVGVPNMVVFLNKQDQVDDEELLELVELEVRELLSSYEFPGDDIPIVSGSALLALEALMANPSIKRGENEWVDKIFTLMDNVDNYIPIPQRQTELPFLMAIEDVFSITGRGTVATGEGRERDC

SEQ ID NO: 577 - protein, 477 aa, Solanum tuberosum
MASISAASATAAAASTKINTSGGSVLPSKSSKLILSSSFTPTPSTLFLHSPATTTPSSSTRHRRFTVRAARGKFERKKPHVNIGTIGHVDHGKTTLTAALTMALASLGNSAPKKYDEIDAAPEERARGITINTATVEYETENRHYAHVDCPGHADYVKNMITGAAQMDGAILVVSGADGPMPQTKEHILLAKQVGVPNMVVFLNKEDQVDDEELLELVELEVRELLSSYEFPGDDIPIHCGSALLALEALMANPSIKRGDDQWVDKIYTLMDSVDEYIPIPQRQTELPFLMAIEDVFSITGRGTVATGRVERGTVKTGEIVDIVGLKDTRNTTVTGVEMFQKILDEAMAGDNVGLLLRGIQKIDIQRGMVLAKPGSITPHTKFEALVYVLKKEEGGRHSPFFAGYRPQFYMRTTDVTGKVTAIMTDKGEESKMVMPGDRVNMVVELIMPVACEQGMRFAIREGGKTVGAGVIQKILE

SEQ ID NO: 578 - protein, 398 aa, Raphanus sativus
HVNIGTIGHVDHGKTTLTAALTMALASMGNSVAKKYDEIDAAPEERARGITINTATVEYETENRHYAHVDCPGHADYVKNMITGAAQMDGAILVVSGADGPMPQTKEHILLAKQVGVPDMVVFLNKEDQVDDAELLELVELEVRELLSSYEFNGDDIPIISGSALLAVETLTENPNVKRGENKWVDKIYELMDSVDSYIPIPTRQTDLPFLLAVEDVFSITGRGTVATGRVERGMVKVGETVDLVGLRETRNYTVTGVEMFQKILDEAMAGDNVGLLLRGIQKADIQRGMVLAKPGSITPHTKFEAIVYVLKKEEGGRHSPFFAGYRPQFYMRTTDVTGKVTKIMNDKDEESKMVMPGDRVKIVVELIVPVACEQGMRFAIREGGKTVGAGVIQTILE

SEQ ID NO: 579 - protein, 479 aa, Glycine max
MAISWAAATTSKLAYPPHVHFSPSPSSNYLFLKTHKPSATHLSSSFIHPTTILHLAAANTTTRRRSFTVRAARGKFERKKPHVNIGTIGHVDHGKTTLTAALTMALASLGNSAPKKYDEIDAAPEERARGITINTATVEYETENRHYAHVDCPGHADYVKNMITGAAQMDGAILVVSGADGPMPQTKEHILLAKQVGVPNIVVFLNKQDQVDDEELLQLVELEVRELLSKYEFPGDDVPIISGSALLSLEALMANPAIKRGENQWVDKIYELMEAVDDYIPIPQRQTELPFLLAIEDVFTITGRGTVATGRVERGTIRVGETVDIVGVKETRNTTVTGVEMFQKILDEALAGDNVGLLLRGIQKTDIQRGMVLAKPGTITPHTKFSAIVYVLKKEEGGRHSPFFSGYRPQFYMRTTDVTGKVTEIMNDKDEESKMVMPGDRVKLVVELIVPVACEQGMRFAIREGGKTVGAGVIQSIIE

SEQ ID NO: 580 - protein, 480 aa, Glycine max
MAVSSASASSKLILFPHASSSSLISTPFRSSTNTHKLSPLSSSFLHPTTVLRRTPSSTTTTTSPRRPLTVRAARGKFERKKPHVNIGTIGHVDHGKTTLTAALTMALAALGNSAPKKYDEIDAAPEERARGITINTATVEYETENRHYAHVDCPGHADYVKNMITGAAQMDGAILVVSGADGPMPQTKEHILLAKQVGVPNMVVFLNKQDQVDDEELLQLVELEVRDLLTSYEFPGDDTPIVSGSALLALEALMANPAIKRGDNEWVDKIYKLMDEVDDYIPIPQRQTDLPFLLAVEDVFSITGRGTVATGRVERGTVKVGETVDLVGLRETRNTTVTGVEMFQKILDEALAGDNVGLLLRGVQKTDIQRGMVLAKPGTITPHTKFSAIVYVLKKEEGGRHSPFFAGYRPQFYMRTTDVTGKVTAITNDRDEESQMVMPGDRVKMVVELIVPVACEQGMRFAIREGGKTVGAGVIQSIIE

SEQ ID NO: 581 - protein, 479 aa, Glycine max
MAVSSATASSKLILFPHASSSSSLNSTPFRSSTTNTHKLTPLSSSFLHPTTVLRRTPSSTTTPRRTFTVRAARGKFERKKPHVNIGTIGHVDHGKTTLTAALTMALAALGNSAPKKYDEIDAAPEERARGITINTATVEYETENRHYAHVDCPGHADYVKNMITGAAQMDGAILVVSGADGPMPQTKEHILLAKQVGVPNMVVFLNKQDQVDDEELLQLVELEVRDLLSSYEFPGDDTPIVSGSALLALEALMANPAIKRGDNEWVDKIFQLMDEVDNYIPIPQRQTDLPFLLAVEDVFSITGRGTVATGRVERGTIKVGETVDLVGLRETRNTTVTGVEMFQKILDEALAGDNVGLLLRGVQKTDIQRGMVLAKPGTITPHTKFSAIVYVLKKEEGGRHSPFFAGYRPQFYMRTTDVTGKVTSIMNDKDEESTMVLPGDRVKMVVELIVPVACEQGMRFAIREGGKTVGAGVIQSIIE

SEQ ID NO: 582 - protein, 482 aa, Helianthus annuus
  misc_feature (2)..(2): Xaa can be any naturally occurring amino acid
  misc_feature (23)..(24): Xaa can be any naturally occurring amino acid
  misc_feature (36)..(36): Xaa can be any naturally occurring amino acid
  misc_feature (41)..(42): Xaa can be any naturally occurring amino acid
  misc_feature (46)..(46): Xaa can be any naturally occurring amino acid
  misc_feature (61)..(61): Xaa can be any naturally occurring amino acid
MXSISAAATAAATFSSSSPSPSXXSSLFTLPKPSTXLLLSXXFLSXSSTNLFLHTSASNSXPAAHRRRALTVRAARGKFERTKPHVNIGTIGHVDHGKTTLTAALTMALASTGGGVAKKYDEIDAAPEERARGITINTATVEYETENRHYAHVDCPGHADYVKNMITGAAQMDGAILVVSGADGPMPQTKEHVLLAKQVGVPNMVVFLNKQDQVDDEELLELVELEVRELLSSYEFPGDDIPIISGSALLALEALTENPKIAKGENKWVDKIYDLMAAVDDYIPIPQRQTELPFLLAIEDVFSITGRGTVATGRVERGTVRIGDSVEIVGLKDTRTTTVTGVEMFQKLLDEAMAGDNVGLLLRGIQKIDIQRGMVLAKPATITPHTKFEALVYVLKKEEGGRHSPFFAGYRPQFYMRTTDVTGKVTSIMNDKDEESKMVMPGDRVKMVVELIMPVACEQGMRFAIREGGKTVGAGVIQSIIE

SEQ ID NO: 583 - protein, 478 aa, Helianthus annuus
  misc_feature (28)..(28): Xaa can be any naturally occurring amino acid
MASISAAATAAASFTSSSSPSPPLFTLXKPSTKLHLSSTFITNLSLHNPNFTSSTPTTTTHRRRALTVRAARGKFERTKPHVNIGTIGHVDHGKTTLTAALTMALASTGGGVAKKYDEIDAAPEERARGITINTATVEYETENRHYAHVDCPGHADYVKNMITGAAQMDGAILVVSGADGPMPQTKEHVLLAKQVGVPNMVVFLNKQDQVDDEELLELVELEVRELLSSYEFPGDDIPIISGSALLALEALTENPKIAKGENKWVDKIYDLMAAVDDYIPIPQRQTELPFLLAIEDVFSITGRGTVATGRVERGTVRIGDSVEIVGLKDTRTTTVTGVEMFQKLLDEAMAGDNVGLLLRGIQKIDIQRGMVLAKPATITPHTKFEALVYVLKKEEGGRHSPFFAGYRPQFYMRTTDVTGKVTSIMNDKDEESKMVMPGDRVKMVVELIMPVACEQGMRFAIREGGKTVGAGVIQSIIE

SEQ ID NO: 584 - protein, 478 aa, Nicotiana tabacum
MASISAATATSSTKLVSSNSTNPLLPSSTKPSKLILSSSFTPNCSTLFLHSPATPSSTATHRHRRFTVRAARGKFERKKPHVNIGTIGHVDHGKTTLTAALTMALASMGNSAPKKYDEIDAAPEERARGITINTATVEYETENRHYAHVDCPGHADYVKNMITGAAQMDGAILVCSGADGPMPQTKEHILLAKQVGVPNMVVFLNKQDQVDDEELLQLVELEVRELLSSYEFPGDDIPIISGSALLALEALMANPSIKRGENQWVDKIYELMDAVDSYIPIPVRQTELPFLMAIEDVFSITGRGTVATGRVERGTVRIGDTVDIVGLKDTRSTTVTGVEMFQKILDEAMAGDNVGLLLRGIQKIDIQRGMVLAKPGTITPHTKFEAIVYVLKKEEGGRHSPFFSGYRPQFYMRTTDVTGKVTSITTDKGEESKMVMPGDRVNLVVELIMPVACEQGMRFAIREGGKTVGAGVIQKIIE

SEQ ID NO: 585 - protein, 478 aa, Solanum lycopersicum
MASISAASATAAAAASTKINTSGTVLPSKSSKLILSSSFTPNPSTLFLHSPATTAPSSSSSRHRRFTVRAARGKFERKKPHVNIGTIGHVDHGKTTLTAALTMALASLGNSAPKKYDEIDAAPEERARGITINTATVEYETENRHYAHVDCPGHADYVKNMITGAAQMDGAILVVSGADGPMPQTKEHILLAKQVGVPNMVVFLNKEDQVDDEELLELVELEVRELLSSYEFPGDDIPIHCGSALLALEALMANPTIKRGDDQWVDKIYKLMDSVDEYIPIPQRQTELPFLMAIEDVFSITGRGTVATGRVERGTVKTGEIVDIVGLKDTRNTTVTGVEMFQKILDEAMAGDNVGLLLRGIQKIDIQRGMVLAKPGSITPHTKFEALVYVLKKEEGGRHSPFFAGYRPQFYMRTTDVTGKVTAIMTDKGEESKMVMPGDRVNMVVELIMPVACEQGMRFAIREGGKTVGAGVIQKILE

SEQ ID NO: 586 - protein, 477 aa, Solanum lycopersicum
MASISAAAATATSSPKLLNPSNPLLPSAAKPSKLILSSSFTPNFSTLLLHSPAATSPTTHHQRRFTVRAARGKFERKKPHVNIGTIGHVDHGKTTLTAALTMALASMGNSAPKKYDEIDAAPEERARGITINTATVEYETENRHYAHVDCPGHADYVKNMITGAAQMDGAILVVSGADGPMPQTKEHILLAKQVGVPNMVVFLNKQDQVDDEELLELVELEVRELLSSYEFPGDDIPIVSGSALLALEALMANPSIKRGENEWVDKIFTLMDNVDSYIPIPQRQTELPFLMAIEDVFSITGRGTVATGRVERGTVRVGETVDIVGLRDTRSTTVTGVEMFQKILDEAMAGDNVGLLLRGIQKIDIQRGMVLAKPGTITPHTKFEALVYVLKKEEGGRHSPFFSGYRPQFYMRTTDVTGKVTSITTDKGDESKMVMPGDRVNLVVELIMPVACEQGMRFAIREGGKTVGAGVIQKILE

SEQ ID NO: 587 - protein, 506 aa, Brassica napus
MAHIHTNGNISPSFPNSYSGEEREIQKNYWKEHSVGLSVEAMMLDSKAADLDKEERPEILSLLPPIEGEKVLEFGAGIGRFTSELAQKAGQVIAVDFIESVIKKNENINGHYKNVKFMCADVTSPDMKFSSESMDLIFSNWLLMYLSDKEVEDLAKKMLQWTKVGGYIFFRESCFHQSGDNKRKYNPTHYREPKFYTKLFKECHMNDDVGNSYEFSLVSCKCVGAYVRNKKNQNQICWLWQKKVSSDNDRGFQRFLDNVQYKSSGILRYERVFGQGFVSTGGLETTKEFVAKLDLKPGQKVLDVGCGIGGGDFYMAENFDVDVVGIDLSVNMISFALEHAIGLKCSVEFEVADCTKKEYPDNTFDVIYSRDTILHIQDKPALFRTFYKWLKPGGKVLITDYCRSPKTPSPDFANYIKQRGYDLHDVQAYGQMLKDAGFDDVIAEDRTDQFMKVLKRELDAVEKEKDEFISDFSKEDYEDIVGGWNSKLLRSSSGEQKWGLFIAKKN

SEQ ID NO: 588 - protein, 506 aa, Brassica napus
MAHIHTNGNISPSFPNSYSGEEREIQKNYWKEHSVGLSVEAMMLDSKAADLDKEERPEILSLLPPIEGETVLEFGAGIGRFTSELAQKAGQVIAVDFIESVIKKNENINGHYKNVKFMCADVTSPDMKFSNESMDLIFSNWLLMYLSDKEVEDLAKKMLQWTKVGGYIFFRESCFHQSGDNKRKYNPTHYREPKFYTKLFKECHMNDDVGNSYEFSLVSCKCVGAYVRNKKNQNQICWLWQKKVSSDNDRGFQRFLDNVQYKSSGILRYERVFGQGFVSTGGLETTKEFVAKLDLKPGQKVLDVGCGIGGGDFYMAENFDVDVVGIDLSVNMISFALEHAIGLKCSVEFEVADCTKKEYPDNTFDVIYSRDTILHIQDKPALFRTFYKWLKPGGKVLITDYCRSPKTPSPDFANYIKQRGYDLHDVQAYGQMLKDAGFDEVIAEDRTDQFMKVLKRELDAVEKEKDDFISDFSKEDYEDIVGGWNSKLLRSSSGEQKWGLFMAKKN

SEQ ID NO: 589 - protein, 270 aa, Brassica rapa
MDKGIGLYPLHRCKTIHLVRHAQGVHNVAGEKDHSAYSSEDYFDAQVTPLGWQQVDHLRNHVLETQLLNKVELVIVSPLLRTIQTAVGAFGGGEDTNGTDATPLMVANAGSSDRPAISGLNSPPFLAVELCRETMGDHPCDRRRSVTEYKAMFPAIDFSIIESDKDVLWKPSPRETPDEVAARGVEFINWLWTRKEKEIAIVSHSGFLHGLLSSFGKDCVEDIKKELSIHFKNCELRSMVIVDQGNLGTDSTETTNYSGKVPQGLDHPSD

SEQ ID NO: 590 - protein, 270 aa, Brassica napus
MDKGIGLYPLHRCKTIHLVRHAQGVHNVAGEKDHSAYSSEDYFDAQVTPLGWQQVDHLRNHVLETQLLNKVELVIVSPLLRTIQTAVGAFGGGEDTNGTDATPLMVANAGSSDRPAISGLNSPPFLAVELCRETMGDHPCDRRRSVTEYKAMFPAIDFSIIESDKDVLWKPSPRETPEEVAARGVEFIKWLWTRKEKEIAIVSHSGFLHGLLSSFGKDCVEDIKKELSIHFKNCELRSMVIVDQGNLGTDSTETTNYSGKVPRGLDHPSD

SEQ ID NO: 591 - protein, 270 aa, Raphanus sativus
  misc_feature (222)..(222): Xaa can be any naturally occurring amino acid
MDKGIGLYPLHRCKTIHLVRHAQGIHNVAGEKDHSAYSSEDYFDAHITPLGWQQVDHLRNHVLETQLLNKVELVIVSPLLRTIQTAVGSFGGGEDTSGADATPLMVANAGSSDRPAISSLNSPPFLAVELCRETMGDHPCDRRRSVTEYKAMFPAIDFSIIESDKDVLWKPSPRETPDEVAARGVEFINWLWTRKEKEIAIVSHSGFLHGLLSSYGKDCVDXIKKELSIHFKNCELRSMVIVDQGNLGTNSTETTNYSGKVPQGLDHPSA

SEQ ID NO: 592 - protein, 270 aa, Raphanus sativus
MDKGIGLYPLHRCKTIHLVRHAQGIHNVAGEIDHSAYSSEDYFDAHITPLGWQQVDHLRNHVLETQLLNKVELVIVSPLLRTIQTAVGAFGGGEDTNGADATPLMVANAGSSDRPAISSLNSPPFLAVELCRETMGDHPCDRRRSVTEYKAMFPAIDFSIIESDKDVLWKPSPRETPDEVAVRGVEFINWLWTRKEKEIAIVSHSGFLHGLLSSYGKDCVDDIKKELSIHFKNCELRSMVIVDQGNLGTNYTETTNYSGKVPQGLDHPSD

SEQ ID NO: 593 - protein, 251 aa, Arabidopsis thaliana
MPIRNIAIGRPDEATRPDALKAALAEFISTLIFVVAGSGSGMAFNKLTENGATTPSGLVAAALAHAFGLFVAVSVGANISGGHVNPAVTFGAFIGGNITLLRGILYWIAQLLGSVVACLILKFATGGLAVPAFGLSAGVGVLNAFVFEIVMTFGLVYTVYATAIDPKNGSLGTIAPIAIGFIVGANILAGGAFSGASMNPAVAFGPAVVSWTWTNHWVYWAGPLVGGGIAGLIYEVFFINTTHEQLPTTDY

SEQ ID NO: 594 - protein, 253 aa, Brassica juncea
MPARNIAIGGVQAEVTHPSALRAALAEFISTLIFVFAGSGSGIAFNKLTDNGATTPSGLVAAALAHAFGLFVAVSVGANISGGHVNPAVTFGAFLGGNITLLRGLLYWIAQLLGSVVACFLLQFATGGLAVPAFGLSAGVGTLNGLVFEIVMTFGLVYTVYATAIDPKNGSLGTIAPIAIGFIVGANILAGGAFSGASMNPAVAFGPAVVSWSWSNHWIYWVGPLVGGGLAGIIYDFVYIIENGHEQLPTTDY

SEQ ID NO: 595 - protein, 253 aa, Brassica juncea
MPTRNIAIGGVQEEVTHPSALRAALAEFISTLIFVFAGSGSGIAFNKLTDNGATTPSGLVAAALAHAFGLFVAVSVGANISGGHVNPAVTFGAFLGGNITLLRGILYWIAQLLGSVAACFLLQFATGGLAVPAFGLSAGVGTLNGLVFEIVMTFGLVYTVYATAIDPKNGSLGTIAPIAIGFIVGANILAGGAFSGASMNPAVAFGPAVVSWSWSNHWIYWVGPLVGGGLAGIIYDFVYIIENDHEQLPTTDY

SEQ ID NO: 596 - protein, 253 aa, Brassica juncea
MPIRNIAIGGVQEEVTHPSALRAALAEFISTLIFVFAGSGSGIAFNKLTDNGATTPSGLVAAALAHAFGLFVAVSVGANISGGHVNPAVTFGAFVGGNITLLRGILYWIAQLLGSVVACLLLKFATGGLAVPAFGLSAGVESLNGFVFEIVMTFGLVYTVYATAVDPKNGSLGTIAPIAIGFIVGANILAGGAFSGASMNPAVAFGPAVVSWTWTNHWIYWAGPLVGGGLAGLIYEVVFINQNGHEQLPTTDY

SEQ ID NO: 597 - protein, 167 aa, Brassica juncea
MPTRNIAIGGVQEEVTHPSALRAALAEFISTLIFVFAGSGSGIAFNKLTDNGATTPSGLVAAALAHAFGLFVAVSVGANISGGHVNPAVTFGAFLGGNITLLRGISLLDCSASWLSRRLLPPSVRHRWLGSSSVRSLRRSWNLKRSCLRDRDDLRARLHRLRHSHRP

SEQ ID NO: 598 - protein, 251 aa, Brassica juncea
MPIRNIAVGRPEEATRPDALKAALAEFISTMIFVFAGSGSGMAFNKLTENGATTPAGLVAASLAHAFGLFVAVSVGANISGGHVNPAVTFGAFVGGNITLLRGILYWIAQLLGSVVACLLLKFATGGLVVPAFGLSAGVGVSNALVFEIVMTFGLVYTVYATAVDPKNGSLGTIAPIAIGFIVGANILAGGAFSGASMNPAVAFGPAVVSWSWSNHWVYWAGPLVGGGLAGLIYEVFFINTTHEQLPATDY

SEQ ID NO: 599 - protein, 251 aa, Brassica juncea
MPIRNIAVGSPNEATRPDALKAALAEFISTMIFVFAGSGSGMAFNKLTENGATTPAGLVAASMAHAFGLFVAVSVGANISGGHVNPAVTFGAFVGGNITLLRGILYWIAQLLGSVVACLLLKFATGGLVVPAFGLSARVGVSNALVFEIVMTFGLVYTVYATAVDPKNGSLGTIAPIAIGFIVGANILAGGAFSGASMNPAVAFGPAVVSWSWNNHWVYWAGPLVGGGLAGLIYEVFFINTTHEQLPTTDY

SEQ ID NO: 600 - protein, 253 aa, Brassica oleracea
MPTRNIAIGGVQEEVTHPSALRAALAEFISTLIFVFAGSGSGIAFNKLTDNGATTPSGLVAAALAHAFGLFVAVSVGANISGGHVNPAVTFGAFLGGNITLLRGLLYWIAQLLGSVVACFLLQFATGGLAVPAFGLSAGVGTLNGLVFEIVMTFGLVYTVYATAIDPKNGSLGTIAPIAIGFIVGANILAGGAFSGASMNPAVAFGPAVVSWSWSNHWIYWVGPLVGGGLAGIIYDFVYIIENGHEQLPTTDY

SEQ ID NO: 601 - protein, 251 aa, Brassica oleracea
MPIRNIAVGRPDEATRPDALKAALAEFISTMIFVFAGSGSGMAFNKLTENGATTPAGLVAASLAHAFGLFVAVSVGANISGGHVNPAVTFGAFVGGNITLLRGILYWIAQLLGSVVACLLLKFATGGLVVPAFGLSAGVGVSNALVFEIVMTFGLVYTVYATAVDPKNGSLGTIAPIAIGFIVGANILAGGAFSGASMNPAVAFGPAVVSWSWNNHWVYWAGPLVGGGLAGLIYEVFFINTTHEQLPTADY

SEQ ID NO: 602 - protein, 251 aa, Brassica rapa
MPIRNIAVGSPNEATRPDALKAALAEFISTMIFVFAGSGSGMAFNKLTENGATTPAGLVAASLAHAFGLFVAVSVGANISGGHVNPAVTFGAFVGGNITLLRGILYWIAQLLGSVVACLLLKFATGGLVVPAFGLSAGVGVSNALVFEIVMTFGLVYTVYATAVDPKNGSLGTIAPIAIGFIVGANILAGGAFSGASMNPAVAFGPAVVSWSWNNHWVYWAGPLVGGGLAGLIYEVFFINTTHEQLPTTDY

SEQ ID NO: 603 - protein, 238 aa, Brassica rapa
MPIRNIAIGGVQEEVTHPSALRAALAEFISTLIFVFAGSGSGIAFNKLTDNGATTPSGLVAAALAHAFGLFVAVSVGANISGGHVNPAVTFGAFVGGNITLLRGILYWIAQLLGSVVACLLLKFATGGLAVPAFGLSAGVESLNGFVFEIVMTFGLVYTVYATAVDPKNGSLGTIAPIAIGFIVGANILAGGAFSGASMNPAVAFGPAVVSWTWTNHWIYWAGPLVGGGLAGLIYEFV

SEQ ID NO: 604 - protein, 253 aa, Brassica rapa; identical to SEQ ID NO: 600

SEQ ID NO: 605 - protein, 272 aa, Brassica napus
MPIRNIAIGGVQGEVTHPSALRAALAEFISTLIFVFAGSGSGIAFNKLTDNGATTPSGLVAAALAHAFGLFVAVSVGANISGGHVNPAVTFGAFVGGNITLLRGILYWIAQLLGSVVACLLLKFATGGLAVPAFGLSAGVESLNGFVFEIVMTFGLVYTVYATAVDPKNGSLGTIAPIAIGFIVGANILAGGAFSGASMNPAVAFGPAVVSWTWTNHWIYWAGPLVGGGLAGLIYEFVFINQNGHEQLPTTDYCLLKTAKTQYDLICFYFAS

SEQ ID NO: 606 - protein, 253 aa, Brassica napus; identical to SEQ ID NO: 600

SEQ ID NO: 607 - protein, 251 aa, Brassica napus; identical to SEQ ID NO: 602

SEQ ID NO: 608 - protein, 253 aa, Brassica napus; identical to SEQ ID NO: 600

SEQ ID NO: 609 - protein, 251 aa, Brassica napus; identical to SEQ ID NO: 602

SEQ ID NO: 610 - protein, 253 aa, Brassica napus
MPIRNIAIGGVQEEVTHPSALRAALAEFISTLIFVFAGSGSGIAFNKLTDNGATTPSGLVAAALAHAFGLFVAVSVGANISGGHVNPAVTFGAFVGGNITLLRGILYWIAQLLGSVVACLLLKFATGGLAVPAFGLSAGVESLNGFVFEIVMTFGLVYTVYATAVDPKNGSLGTIAPIAIGFIVGANILAGGAFSGASMNPAVAFGPAVVSWTWTNHWIYWAGPLVGGGLAGLIYEFVFINQNGHEQLPTTDY

SEQ ID NO: 611 - protein, 253 aa, Raphanus sativus; identical to SEQ ID NO: 610

SEQ ID NO: 612 - protein, 253 aa, Raphanus sativus
MPARNIAIGGVQEEVTHPSALRAALAEFISTLIFVFAGSGSGIAFNKLTDNGATTPSGLVAAALAHAFGLFVAVSVGANISGGHVNPAVTFGAFLGGNITLLRGLLYWIAQLLGSVAACFLLQFATGGLAVPAFGLSAGVGTLNGLVFEIVMTFGLVYTVYATAIDPKNGSLGTIAPIAIGFIVGANILAGGAFSGASMNPAVAFGPAVVSWSWSNHWIYWVGPLVGGGLAGIIYDFVYIIENGHEQLPTTDY

SEQ ID NO: 613 - protein, 251 aa, Raphanus sativus
MPIRNIAVGRPDEATRPDALKAALAEFISTMIFVFAGSGSGMAFNKLTENGATTPAGLVAASLAHAFGLFVAVSVGANISGGHVNPAVTFGAFVGGNITLLRGILYWIAQLLGSVVACLLLKFATGGLAVPAFGLSAGVGVSNALVFEIVMTFGLVYTVYATAVDPKNGSLGTIAPIAIGFIVGANILAGGAFSGASMNPAVAFGPAVVSWSWNNHWVYWAGPLIGGGIAGLIYEVFFINTTHEQLPTTDY

SEQ ID NO: 614 - protein, 251 aa, Raphanus sativus
MPIRNIAVGRPDEATRPDALKAALAEFISTMIFVFAGSGSGMAFNKLTENGATTPAGLVAASLAHAFGLFVAVSVGANISGGHVNPAVTFGAFVGGNITLLRGILYWIAQLLGSVVACLLLKFATGGLVVPAFGLSTGVGVSNALVFEIVMTFGLVYTVYATAIDPKNGSLGTIAPIAIGFIVGANILAGGAFSGASMNPAVAFGPAVVSWSWNNHWVYWAGPLIGGGIAGLIYEVFFINTTHEQLPTTDY

SEQ ID NO: 615 - protein, 253 aa, Thellungiella halophila
MPIRNIAIGGVQEEVTHPSALRAALAEFISTLIFVFAGSGSGIAFNKLTDNGATTPSGLVAAALAHAFGLFVAVSVGANISGGHVNPAVTFGAFLGGNITLLRGILYWIAQLLGSVVACFLLTFATGGLAVPAFGLSAGVGSLNAFVFEIVMTFGLVYTVYATAIDPKNGSLGTIAPIAIGFIVGANILAGGAFSGASMNPAVAFGPAVVSWSWSNHWVYWAGPLVGGGLAGLIYEFVFIGGNDHEQLPTTDY

SEQ ID NO: 616 - protein, 281 aa, Brassica napus
  misc_feature (231)..(231): Xaa can be any naturally occurring amino acid
MARTGTAKKNGAGQFFLATLLLWLVSVVFEIAFNLRTELLWVIGGGCFFQSVNWFVRSCLSRDPLFVNTSVSLLHSIITSASVVFILLNQCLAKGVDEMFDHSELVGGSWRWAYQALCFSCGYFAYDQWDMLQYRLYSGLIPSILVHHLVLLVCFTLALYRNVTINYLILTLICEMHSIFLHVRKLRRMAGIRDSNTALVKLEWVLNWTAFVFARCVPHILITVKLIKDAXKFERGVEWPLALFGMAGMNILNVGLGMDLFHAFRRERSNRRNQEKSNHVE

SEQ ID NO: 617 - protein, 280 aa, Raphanus sativus
  misc_feature (108)..(108): Xaa can be any naturally occurring amino acid
MARTGTGKNGAGQFFLATLLLWLVSVVFEIAFNLRTELLWVISGGCFFQSANWFVRACLSRDPLFVNTSVSLLHSIITSASVVFILLNQCLEKGVDEMFDHSELVGGXWNWAHPALCFSCGYFAYDQWDMLRYRLYSGLIPSILVHHLVLLVCFTLALYRNVTINYLILTLICEMHSIFLHVRKLRRMAGIRDSGTALVKLEWVLNWTAFVFARCIPHILITVKLIKDAHKFGRGVEWPLALFGMAGMNILNVGLGMDLFHAFRRERSNRRNQEKRNHVE

SEQ ID NO: 618 - protein, 113 aa, Hordeum vulgare
MKFIAAYLLAYLSGNASPSAEDLTSILESVGCEIDNEKMELMLCQVKGKDITELLAAGREKFAAVPSGGGGVAVSAAAPSAGGAAAPAAESKKEEKVVEKEESDDDMGFSLFD

SEQ ID NO: 619 - protein, 113 aa, Brachypodium distachyon
MKFIAAYLLAYLSGNSSPSAEDLTTILESVGCEIDNEKMELMLSQVKGKDIAELLAAGREKFASVPSGGGGVAVAAAAPASGGGGAAPAAEKKEEKVVEKEESDDDMGFSLFD

SEQ ID NO: 620 - protein, 112 aa, Cenchrus ciliaris
MKFVAAYLLAVLAGNPSPSAEDLSAILESVGCEIDNEKMELLLSQLSGKDITELIAAGREKFASVPCGGGGVAVAAAAPAAGGAAPAAEAKKEEKVEEKEESDDDMGFSLFD

SEQ ID NO: 621 - protein, 112 aa, Festuca arundinacea
MKYIAAYLLAYLGGNSCPSAEDLTSTLESVGCEIDAERLELLLSQVKGKDITELLAAGREKFASVPSGGGGVAVAAAAPTSGGAAPAAESKKEEKVVEKEESDDDMGFSLFD

SEQ ID NO: 622 - protein, 113 aa, Leymus cinereus x Leymus triticoides
MKFIAAYLLAYLSGNASPSAEDLTSILESVGCEIDNEKMELMLSQVKGKDITELLAAGREKFAAVPSGGGGVAVSAAAPAAGGAAAPAAESKKEEKVVEKEESDDDMGFSLFD

SEQ ID NO: 623 - protein, 111 aa, Eragrostis curvula
MKFVAAYLLAVLAGNPSPSAEDLTAILESVGCEIDNEKMELLLSQLSGKDITELIAAGREKFASVPCGGGGVAVAAAAPAAAGGAPAAEAKKEEKVEKEESDDDMGFSLFD

SEQ ID NO: 624 - protein, 129 aa, Eragrostis curvula
LFAAAPLLLGLSSPPDQDEVVAAYLLAVLAGNPNPSAEDLTGILESVGCEIDNEKMELLLSQLSGKDITELIAAGREKFASVPCGGGSVAVAAAAPAAGGGAPAAEAKKEEKVEEKEESDDDMGFSLFD

SEQ ID NO: 625 - protein, 112 aa, Eragrostis curvula
MKFVAAYLLAVLAGNNNPSAEDLSAILESVGCEIDNEKMELLLSQLSGKDITELIAAGREKFASVPSGGGGVAVAAAAPSAGGAAPAAEAKKEEKVEEKEESDDDMGFSLFD

SEQ ID NO: 626 - protein, 112 aa, Zea mays
MKVVAAYLLAVLAGNASPSAEDLTGILESVGCEVDNERMELLLSQLSGKDITELIAAGREKFASVPCGGGGVAVAAGAPAAGGAAPAAEAKKEEKVEEKEESDDDMGFSLFD

SEQ ID NO: 627 - protein, 113 aa, Zea mays
MKFVAAYLLAVLAGNSSPSAEDLTAILESVGCEVDNEKMELLLSQLSGKDITELIAAGREKFASVPCGGGGGMAVAAAGPAAGGAAPAAEAKKEEKVEEKEESDDDMGFSLFD

SEQ ID NO: 628 - protein, 112 aa, Zea mays
MKFVAAYLLAVLAGNASPSAEDLTAILESVGCEVDNERMELLLSQLSGKDITELIAAGREKFASVPCGGGGVAVAAASPAAGGAAPTAEAKKEEKVEEKEESDDDMGFSLFD

SEQ ID NO: 629 - protein, 112 aa, Zea mays
MKFVAAYLLAVLAGNASPSADDLTAILESVGCEVDNEKMELLLSQLSGKDITELIAAGREKFASVPCGGGGVAVAAAAPAAGGAAPAAEAKKEEKVEEKEESDDDMGFSLFD

SEQ ID NO: 630 - protein, 113 aa, Zea mays; identical to SEQ ID NO: 622

SEQ ID NO: 631 - protein, 222 aa, Zea mays
  misc_feature (84)..(84): Xaa can be any naturally occurring amino acid
MKFVAAYLLAVLAGNASPSAEDLTAILESVGCEVDNERMELLLSQLSGKDITELIAAGREKFASVPCGGGGVAVAAASPAAGGXLLQLRQRKKRRWKRRKKAMMIWASASSTRLDGAVQRPGHQRQQPHGALLLQHRPGAGPLPHAPARHLPVLAVASDVAPGPVHRAHLRPDRIQGQDRGLLREVKRLRSYPSSLVLRCIALRACSPQSNLCCIGFRFRRM

SEQ ID NO: 632 - protein, 112 aa, Zea mays; identical to SEQ ID NO: 629

SEQ ID NO: 633 - protein, 112 aa, Pennisetum glaucum
MKFVAAYLLAVLAGNNSPSAEDLTTILESVGAEVDNEKMELLLSQLSGKDITELIAAGREKFASVPCGGGGVAVAAAAPASGGGAPAAEAKKEEKVEEKEESDDDMGFSLFD

SEQ ID NO: 634 - protein, 113 aa, Pseudoroegneria spicata; identical to SEQ ID NO: 622

SEQ ID NO: 635 - protein, 113 aa, Oryza sativa
MKFISAYLLATLAGNPNPSAEDLTTILESVGAEVDHGKMELLLSQLAGKDITEIIASGREKFASVPCGGGGVAVAAAAPAAGGGAAPQSEAKKEEKVEEKEESDDDMGFSLFD

SEQ ID NO: 636 - protein, 112 aa, Sorghum bicolor
MKFIAAYLLAVLAGNSSPSAEDLTAILESVGCEVDNERMELLLSQLSGKDITELIAAGREKFASVPCGGGGVAVAAAAPAAGGAAPAAEAKKEEKVEEKEESDDDMGFSLFD

SEQ ID NO: 637 - protein, 112 aa, Sorghum bicolor
MKFIAAYLLAVLGGNLSPSAEDLAAILESVGCEVDNEKMELLLSQLSGKDITELIAAGREKFASVPCGGGGVAVAAAAPAAGGAAPAAEAKKEEKVEEKEESDDDMGFSLFD

SEQ ID NO: 638 - protein, 112 aa, Sorghum bicolor
MKFVAAYLLAVLAGNNDPSVEDLKTILESVGAETDSEKMEHLLSQVSGKDITELIAAGREKFASVPCGGGGVAVAAAAPAAAGGAAPAAEKKEEKVEEKEESDDDMGFSLFD

SEQ ID NO: 639 - protein, 112 aa, Saccharum officinarum
MKFVAAYLLAVLAGNSSPSAEDLTAILESVGCEVDNERMELLLSQLSGKDITELIAAGREKFASVPCGGGGVAVAAAAPAAGGAAPAAEAKKEEKVEEKEESDDDMGFSLFD

SEQ ID NO: 640 - protein, 112 aa, Saccharum officinarum; identical to SEQ ID NO: 637

SEQ ID NO: 641 - protein, 112 aa, Saccharum officinarum; identical to SEQ ID NO: 637

SEQ ID NO: 642 - protein, 112 aa, Saccharum officinarum
MKFVAAYLLAVLAGNNDPSVEDLKTILESVGAEIDTEKMEHLLSQVSGKDITELIAAGREKFASVPCGGGGGVAVAAAAPTAGGAAPAAEKKEEKVEEKEESDDDMGFSLFD

SEQ ID NO: 643 - protein, 112 aa, Panicum virgatum; identical to SEQ ID NO: 620

SEQ ID NO: 644 - protein, 112 aa, Panicum virgatum
MKFVAAYLLAVLAGNPSPSAEDLSSILESVGCEIDNEKMELLLSQLSGKDITELIAAGREKFASVPCGGGGVAVAAAAPAAGGAAPAAEAKKEEKVEEKEESDDDMGFSLFD

SEQ ID NO: 645 - protein, 112 aa, Panicum virgatum
MKFVAAYLLAVLAGNPSPSAKDLSSILESVGCEIDNEKMELLLSQLSGKDITELIAAGREKFASVPCGGGGVAVAAAAPAAGGAAPAAEAKKEEKVEEKEESDDDMGFSLFD

SEQ ID NO: 646 - protein, 112 aa, Panicum virgatum; identical to SEQ ID NO: 644

SEQ ID NO: 647 - protein, 114 aa, Panicum virgatum
MKFVAAYLLAVLAGNPSPSAEDLSAILESVGCEIDNEKMELLLSQLSGKDITELIAAGREKFASVPCGGGGGGVAVAAAAPAAGGAAPAAEAKKEEKVEEKEESDDDMGFSLFD

SEQ ID NO: 648 - protein, 112 aa, Panicum virgatum
MKFVAAYLLAVLAGNPSPSAEDLSAILESVGCEIDSEKMELLLSQLSGKDITELIAAGREKFASVPCGGGGVAVAAAAPAAGGAAPAAEAKKEEKVEEKEESDDDMGFSLFD

SEQ ID NO: 649 - protein, 112 aa, Panicum virgatum; identical to SEQ ID NO: 648

SEQ ID NO: 650 - protein, 113 aa, Triticum aestivum; identical to SEQ ID NO: 622

SEQ ID NO: 651 - protein, 113 aa, Triticum aestivum; identical to SEQ ID NO: 622

SEQ ID NO: 652 - protein, 299 aa, Hordeum vulgare
  misc_feature (24)..(24): Xaa can be any naturally occurring amino acid
AERGEGARRLARGRVRLSARHDAXMPPPRRAGAGDTSAFFAATLVLWAVSVGFEIGARGRRELAAVAAGFAFFQAANTAVRAAVSRDPLFVNTAVSLLHSSLTSASVIFVLLCQWRTKGLENMFQHEELVGSSWIGAYSALCFSCGYFAYDQLDMLRYRLYSGWIPGILMHHLILLICFTLALYRNVTINYLILTLLCEMHSIFLHVRKLRRMAGFRDFNRKLVKLEWVLNWTTFVTARVICHILITYRLITDAHKFDKGIELPLALSGMAGMNVLNVSLGLDLFKAFARERNQQTHQD

SEQ ID NO: 653 - protein, 177 aa, Zea mays
MFEHEELFGGSWIGAYSALCFSCGYFAYDQLDMLRYRLYSGWLPGILMHHLILLICFTLALYRNVTINYLNLSLVCELHSIFLHVRKVRRMVGFRDFDRTVVKLEWVLNWTTFVTARVICHILITYKLISDAHKFGKGIELPLALLGMAGMNLLNIFLGLDLLKAFTRERNKQNHQD

SEQ ID NO: 654 - protein, 275 aa, Pseudoroegneria spicata
MPPPRRAGAGDTSAFFAATLVLWAVSVGFEIGARGRRELAAVAAGFAFFQAANTAVRAAVSRDPLFVNTAVSLLHSSLTSASVIFVLLCQWRTKGLENMFQHEELVGSSWIGAYSALCFSCGYFAYDQLDMLRYRLYSGWIPGILMHHLILLICFTLALYRNVTINYLILTLLCEMHSIFLHVRKLRRMAGFRDFNRKLVKLEWILNWTTFVTARVICHILITYRLITDAHKFDKGIELPLALSGMAGMNVLNVSLGLDLFKAFARERNQQTHQD

SEQ ID NO: 655 - protein, 278 aa, Sorghum bicolor
MPPHRAGGAAGGGDTSAFFAATLVLWAVSVGFEIGVRGRRELAPVAAGFAFFQAANAAVRGSVSRDPLFVNTAVSLLHSSLTSVSVIFVLVHQWRNKGFETMFEHEELFGGSWIGAYSALCFSCGYFAYDQLDMLRYRLYSGWIPGILMHHLILLICFTLALYRNVTINYLILSLVCELHSIFLHVRKVRRMVGFRDFHRTMVKLEWVLNWTTFVTARVICHILITYKLIADAHKFGKGIELPLALLGMAGMNLLNIFLGLDLLKAFTRERNQQNHQD

SEQ ID NO: 656 - protein, 302 aa, Triticum aestivum
RGEGGTSRLACGRVRLSARHAETARAPMPPPRRAGAGDTSAFFAATLVLWAVSVGFEIGARGRRELAAVAAGFAFFQAANTAVRAAVSRDPLFVNTAVSLLHSSLTSASVIFVLLCQWRTKGLENMFQHEELVGSSWIGAYSALCFSCGYFAYDQLDMLRYRLYSGWIPGILMHHLILLICFTLALYRNVTINYLILTLLCEMHSIFLHVRKLRRMAGFRDFNRKLVKLEWVLNWTTFVTARVICHILITYKLITDAHKFDKGIELPLALSGMAGMNLLNVSLGLDLFKAFARERNQQTHQD

SEQ ID NO: 657 - DNA, 1552 bp, Oryza sativa
aacaatggagagcgagatggcggcggtggggtccaccctcaccatggagcgcgtcgccacggcgaagaagttcatcgagaaccactaccgctcgcagatgaagaacatccaggagcgcaaggagaggcgctttagattggagcgacaactggaatcttcccaagttcccagggagcagcaaatcaatctactaaaagatctggagagaaaggaaacagagtacatgcggcttaaaaggcacaaaatctgcgttgatgactttgagctgctcaccattattggcagaggagcttttggagaggttcgactctgccgggagaagacatctagcaacatttatgcaatgaaaaagctaaagaagtctgatatggttgtcaggggtcaagtggaacatgttagagcggaaagaaacttgctggctgaagttgctagccactgcattgtgaagctatactattcttttcaagattcggagtacctttatcttatcatggagtatctccctggtggtgatatcatgacccttctcatgagagaggataccttaactgagcatgtggctcgattctacattgctgagaccatccttgctattgagtccattcataaacacaactacatccacagagatattaagcctgacaacctgcttctcgacaagaatggtcacatgaagctgtcagattttgggctgtgcaagccaattgattgttcaaagctctcaacattgaatgaagatgaaccgatgggtgatgacaatttgagggaatcaatggatatcgatagctctttctctgaaacaacaaatggtagaaggtggagaagtcaacatgaacaacttcagcactggcagatgaacagaagaaaactggcattctcaactgttgggacaccagactatattgctccagaagttctgctaaagaagggatatggaatggaatgtgactggtggtctttgggtgcaatcatgtatgagatgcttgttggttatccaccattttattctgatgatccaataaccacatgccgaaagattgtccactggagaaaccatttgaaatttccagaggattcaaaggtgtctcctgaagcaagggatctcatttgccggttattatgtgatgttgaccacaggattggcagtgcaggagcagaccaaataaaggcacatccttggttccgtggagttgcttgggaaaaactatatgagatggaagctgcatttaagcctcaagtaaatgatgaactggacacacagaacttcatgaagtttgaggaaatggataatgctccaaccagaacaggttccgggccctcaagaaagatgatgctgaattccaaagacctcagctttgtgggatatacgtacaaaaactttgatgctgtgaaaggattgaaacattcagatcaacaaaggaaccaatctctaataaggccctctattggctccatttttggtccagcagatatggatccatctagagaaccaaatggaagggacaagcacatgcacacagtttcttctggtgatccgatgattcaatgatga

SEQ ID NO: 658 - DNA, 428 bp, Brassica napus
aaaccatgaccgtcgtctctctgttagtcgccttcaccgttgttgcactctgtttacactcttcaacatctgagttcctgaagtttcagctttccaccatatcagctgcacctacgtttttgcctgaagctccttcgagtttctcagcttcacctccggaggctatgtctccagatatatctcctctgttccctactccaggttcaagcgaaacgtctccttctccgtcagaatcttttgacatcccgacaatcccctcgagccttagtccaccaaatccagatgccgtctctcctgatcctctgcttgactcttctcccgtggggtctcctcttcctgcttcttcctctgtttctctggtctcgtcaccactctctctgcttctggccttccccatgttaatgctagctttctgcagattctaataa

SEQ ID NO: 659 - DNA, 557 bp, Brassica napus
cagtgatgaggaagctcaagtttcatgagaagaagattataaggaaaacgaacttcttggaatggaagagagaaggtggccatcgcgaaaacctcatcacgactcgttaccacatgggtggtcgtgacgattacaaaaaatattcagggttgtgtaggatggtgcagaagctgactaatgtaatgaaacagatggacccaactgatccttttcggattcagatgactgatttgctccttgagaaactatacaacatgggcgttataccgactaggaaaagcttggctttaactgatcgcttatcagtttcctccttctgtaggcgtaggctatcgactgtactggttcacctgaagtacgcagagcatttgacagaagccgtgacgtatatagagcaaggacacattcgtgtaggaccagacacgattactgatccagctttcttggtaacaaggaacatggaagatttcatcacttgggttgattcttccaagattaaacgcaaggtgcttcagtacaatgacaaattagatgactacgacatgcttgcttaataa

SEQ ID NO: 660 - DNA, 995 bp, Brassica napus
tccacatgacttcagatgctctcaacataccatccgagcttgaatctgcgttacggctcaggactgtacaatactttatcacaaagaggccttggcttgatctctatggagtccatgtaaggcccgtggcaccattcggaagcacaagcagtaaaccacagttcgatccagcattgatccatcgttccttgcctgatgagcttcttttcgaggtgtttgctcggatgttgccttatgaccttggcagagcagcttgtgtctgcagaaagtggaggtacactgttcgcaaccctgtcttctggcgtaacgcgtgcttgaaagcttggcagactgctggagttatcgaaaactataggatcttgcagtctaaatacgatggatcatggaggaaaatgtggcttcttagatccagagttcgtactgatggtatttatgtgagtagaaacacttacattcgagctggaattgctgagtggaagattacaaatccagttcacattgtatgttacttccgctacataagattctacccttctggcaggtttctttacaagaactcttcgcagaagttgaaggatgttgccaaatacatgatctttaagtcttctaaagcagacggtctttacagaggcacttacacattgtcaatgacagatgacaagatcgaagcagctgttctgtatccagggacgcgccctactgtcttaaggatccgtttaaggttaagaggaacggcgattggagcgaataacaggatggatttgctgtcactagtgacgagtggtgtgaacgacgaggaaggaagtagcacagaagaggacattcttggggtagttgagaattggagagacgacgagactcacaatccggatatacctgccgtctcacacaagaggggtatgactcccttcgtcttcgtcccgttcgaagaggttgaacaatcggtcttgaacttacctccagagaaaatggattactttgtcaccggctagtag

SEQ ID NO: 661 - DNA, 818 bp, Brassica napus
aaaagatgcaagttgtttctcctttatctccggcgacgagattcgtcggagaagagagcttcgccgagctttacggcaaactaaacgctgacttcagctcgaaactgaaggtcggttttacaaacgaggaagaagaaaagaacagagatgacaacaagtcttggtggaatcaagatgatgatgatgatgagagagaagaaggagaagaagatgaagagttctcgttcacgagcttaaacgcagataactcaccgataaccgcagacgaagccttcgaagacggtcagatccgaccggtttatccactctttaaccggaatctcctcttcgaaccggaagagagagatctccgctcgcctctcaagaagctcttcgtggagagcgaggaagccgccaccaccgaaagggaggaagaatctgagccgatgggaccgtactgctcgtggtcaggcagaaccgtggtggaggaagcttcgccggagacttgtcggaaaagcagttcgacggggttctcgaagctgtggaggtttaaagatctcgtttcgagaagcaacagcgacggaaaagacgcgtttgtgtttctgaatcacggcgacaagaagaagcagtcttcttctaagccggcggctaaattgagcggcggcgtgaagagaacggagacgaaaacgacgagatcggcacatgagaggttatacatgaggaacagagcgatcagagaagaagggaaacgaagatcgtatcttccttacaaacatgtcggattcttcaccaatgtcaatggacttactagaaatgttcatccttactgatcatcatga

SEQ ID NO: 662 - DNA, 2693 bp, Arabidopsis thaliana
cgtagacacgtattttgaagggaattacaaaattttaatactatctcttaccaaaaaattagaaaatagagagaagaaaaatgaaagtggcagttataggaagtggtataagtggattaggaagtgcttacgtacttgcgaatcaaggagttaaagaagttgtgttgtacgagaaagaagagtcattaggaggccatgccaagacggtgcgtttcgatggcgttgacttggatcttggtttcatggtctttaatcgtgttacatatccaaacatgatagagttcttcgagaaccttggagtagagatggaggtttcagacatgtctttcgcagtgagccttgacaatggcaaaggttgtgaatggggaagccgcaacggtgtctcgggcttatttgctcaaaagaagaacgttttaaatccgtatttctggcaaatgatcagagaaattgttagatttaaagaagacgtcttaaattacattgagaagcttgagggtaaccccgatatcgatcgaaaggaaaccttaggagaatttctcaatacacgtggatactctgagttgtttcagcaagcttacttagtaccgatatgcggttcgatatggtcatgcccatcagatggtgtcttaagcttctctgcttactctgttctttcgttttgttgcaaccaccaccttcttcagatctttgggaggccacagtggctaactgttgcaggacgttctcagacttacgtcgcaaaggttagggcagaattggagagactaggatgcaagatcagaacaagctgcgacgtaaaatctgtttcgacatccgaaaatggttgtgtaactgttacaagtggagatgggtctgaagaagtattcgataggtgcatattggctatgcacgccccagatgctctgagattgcttggtgaagaagttacatttgacgaatctagggttcttggtgctttccaatacgtttacagcgatatatatctccatcatgacattgatttgatgccacggaacaaagcagcgtggagtgcgtggaatttcttgggaagtacggaaaagaaagtatgtgtaacatactggctcaatatacttcagaaccttggcgagaacagtgaaccattctttgtaacacttaacccagacgagaccccaaagaaagcattgctcaaatggaccactggtcaccctgtaccatcagttgcagcttcgatagcttcacaagagcttcaccagattcaaggcaaacgtaacatatggttctgtggtgcatatcagggctatggtttccatgaagacgggctaaaggccggtatggcggctgcacgaggtttgttagggaaagaaacagctcttctgaacaatccgcgacatatggtcccttccttgacagaaacaggagctcggcttttcgttactagattcttgggacaatttatatcaaccggttctgtaacaatactagaagaaggaggaacaatgttcacattcggagggaaggattctacttgtcctctgaaatctatcctcaagattcacagtcctcaattttactggaaggttatgacacaagcggatttaggacttgcagatgcttatatcaatggagatttttctttcgttgataaagaatcaggacttttaaatctgattatgattctcattgctaacagagatacaaaatcaaatcttactaagaaaaggggatggtggacaccgatgtttttaactgcgggtttagcatctgcaaagtattttctaaagcatgtctctaggcagaacactctaacacaagctcgtagaaacatttctcgtcactatgaccttagcaacgagcttttcggtttgttcttggatgataccatgacttactcctcggcagtattcaagtcggatgatgaggatctgagaactgcacagatgagaaaaatatctcttctgattgataaggcgagaatagagaaggaccatgaggttttagagataggatgtggatggggaactttggccatagaagttgtgagaagaactggatgcaaatacaccggcattacgctatctattgagcagcttaaatatgctgaagaaaaagtgaaagaagctggacttcaggaccggattacttttgagctccgcgattatcgccaactatctgatgctcacaaatatgacagaattatatcttgcgagatgctagaagcggtcggacatgagtttatggagatgtttttcagtcgatgtgaagccgcacttgctgaagacggcctaatggtcttgcagttcatatcgacacccgaagagcgttacaatgagtacagactaagttcagatttcattaaagaatacatattccctggtgcatgcgttccttctttagccaaagtcacttcagccatgtcctcttcttctaggctatgcattgaacatgttgagaacattgggattcattactaccaaacattgagattgtggaggaagaacttcttggagagacagaaacaaatcatggctcttggatttgatgataaattcgtaaggacatgggaatattattttgattattgcgcagctggattcaagactcgtactcttggagactaccagttggtgttctcgcgtccagggaacgtagctgcatttgcggattcataccgaggatttccttctgcttattgtgtctcttgagagcattaa

SEQ ID NO: 663 - DNA, 1321 bp, Arabidopsis thaliana
aacaatgtcaagactcgatgatatcccttcttctcctggaaagttcaagatggaaaagtcatcttacctccatagactcagattccagtcatctttgactaagttcgctttcttctctttcttccttttgtgcctcatctcattgctcttcctcagatcacctccttctatcaacccatcttctccatctgatccttcaagaagatctctcagaactaacacttacggtggtcctgcttgggagaagagactcagatcttctgctagaatcagaacttctactaacaacggtatcactgtgcttgttactggtgctgctggattcgttggtactcatgtgtctgctgctctcaagagaagaggtgatggtgttatcggacttgataactttaacgattattatgatccttcactcaagagagctagaagagctttgcttgagagatcaggaatcttcatcgttgagggtgatatcaacgatgtggagcttctcagaaagctcttcaagattgtgtctttcactcatgtgatgcatcttgctgctcaggctggtgttagatatgctatggaaaacccatcttcatacgtgcattctaacatcgctggtttcgtgaaccttttggagatctgcaagtcagttaaccctcagcctgctattgtgtgggcttcttcttcttctgtgtacggtctcaacactaaggtgccattctctgagaaggataagactgatcagcctgcttctctttacgctgctactaagaaagctggtgaagaaattgctcatacttataaccatatctacggactctcactcactggactcagattcttcactgtttatggtccatggggtagacctgatatggcttacttctttttcacaaaggatatcctcaagggaaagtctatctctatcttcgagtctgctaaccatggaactgttgctagagatttcacatatatcgatgatatcgttaagggatgccttgctgctcttgatactgctgagaagtctactggatctggtggaaagaagagaggacctgctcaactcagagttttcaacttgggaaacacttctcctgtgcctgtgtctgatcttgttagaatcctcgagagacagctcaaggttaaggctaaaaagaacctcatcaagatgcctagaaatggtgatgtgcctttcacacatgctaacatctcactcgctcagagagagcttggatacaagcctactactgatcttcagactggactcaagaaatttgtgagatggtacttgtcttactactctggtgataagaaggctgctgctagataatga

SEQ ID NO: 664 - DNA, 358 bp, Arabidopsis thaliana
tcagcttcagatggtgattccaccagcagtgagaccaccacgtctcttcgactacctaaaaccttacgtgctgaaaatgcatttcacaaacaagtttgtccacgcacaagtcatccactcaccaacagccacagtggcttgctcagcgagctcgcaagagaaagcattgagagaaacaatggacatcacacgcgacgtcgctgctgcttcaaagattggtaaaattcttggagaaagactcttgatgaaagatattcccgctgttactattcagatgaagaaagaacagaggtatcatggtaaagtcaaggctgttatcgattctgtaagagaagctggtgtcaagttgctctgatga

SEQ ID NO: 665 - DNA, 1307 bp, Arabidopsis thaliana
agaagatgaagctaaaatgggaatcaatctctaatcttcaacaaaacacatatctcataaaactcgtcgctgcaacacttataacttgtctcgcttttcgtttcttcgtcttccgcttcggccaattttccccagttcaagtgtcggtgaccggaaactccaattcccagatttctccgacgtctgttatcttatcggataacgaagatcaaattcccgtcgatattgaggtggagaagtgtgatctatttactgggaaatggattaaagatcctttgggaccaatctacacgaatgagtcatgtggtatcgttgtagatgctcaccagaattgcatcactaatggtcgacctgattctggttttctcaattggaaatggaagcctaatgactgttccttgcctcggtttgattctctgagatttctgcagcttatgaggaataaatcttgggctataatcggtgactccattgctcgtaaccatgtcgagtctttgctttgtatgctatctacagttgaaaaacctgttgaagtgtatcacgatgagaactatagatcgaagcgttggcattttccttcgtataactttacggtatccaacatttggtcaccttttcttgttcaagctgatatctttgaagactcaaatggtgtctcatcagctgcagttcagcttcatctagataaactcgacaatacatggactgatctattcccgagccttgactatgcgatcatctcttcaggggaatggttcttgaaaactgcggtataccacgagaatgctaatcccgttggatgccatggctgcccggagagttcgaacatgacggatttaggattcgactatgcttacaatacgtcgttgcgccatgttatggacttcatagcgaaatctaaaactaaaggcatgatctttttccggacttcgatacctgatcattttgaagatggggaatggcataacggtgggacttgtaagaaaacagaaccggtgggtgaagaggcagtcgagatgaaagttctgaacaagatattgagagatgttgagattaatcaattcgagagagtggttacggagatgggtcaggagagtgagaatctaaagcttctggattttgctggcatgttgctgactcgacccgatggtcatccgggtccatatagagagtttaggccgtttgataaagataagaacgctacggtacagaacgattgtctgcattggtgcttgcctggtccgattgatcacttgaacgatgtcatattggagatcatagtgaatggtcgaaccggtaaataataa

SEQ ID NO: 666 - DNA, 953 bp, Arabidopsis thaliana
accttggaacgattttgccggagcttgcaatggcgcaactaatacgaccaataaggcaattgtcgccgcaatgtaatcaccattttcgtaatctccggtatttgttttcgaaaaagctaccgaacccaccttcttctatccccactcttcttctcttctcgtctttctccactgaaaggtctccacctcgtcggcgaattcgtcccgcgccaccggaagctttaaagcctactgttattgttgccgaagaagatggtgataacgatggttacgagtctgattcgttgaggagtcgtaaccagcggaagcgtgatgctcgccgtgccgttaaatggggtatggaacttgcttccttctccggtgatcaggttaagcagattctgaaagctgcgtcgcttggtgaagaggtttatgatgcattgatgcttgcgaagagactaggctcggatgttcgagaaggaaagcgtagacatttcaactatattgggaaattgttgcgtgaagttgaacctgatttgatggacactctgattaatgctacaaagcagggtgatcactcaacgctgcagacgctgattagttcagcaaaggatgtcgcagatgatgttggagacagttatgatgatgatacagaaacagagtcagaagatgaagaggaggggtctgacgaatatacggctatggctgcgagatggtttgatggcctaatcagtcaaaatgtggaacttacaaaggaggtttattctcttcagagtgttgatttcgatagacaggaattgcgtaaacttgttcggaaagtacagttggttcatgagcaaagaaaaggcacaacagaggagaagcagaaagaagttgaggctgcattagtgactgctgaaaagtctctgaatcaattcctctgctccatggcgaaacaagtgcacagtgagcagactgatttgtacttatgataa

SEQ ID NO: 667 - DNA, 1029 bp, Arabidopsis thaliana
agtttctccgtcgacgataccaaaggcgattcagcttgatttgtttgatccaacgttttgatcatgaaatcgggagagcaaccacatatactcaatatacaaccgccggaatgatgatcgacgatgagattgttcaccaagtcaacttcaaaccggatcttgtggttatattgttcaattctttgtaacaccaggagcttctatcatgtggctatctcatgagctcttaccaagaggtagaatccagctctgtctcaagtatatctcttttaatgcacttcgagttttctgaaatttttgctcaaaaaacatggttgtggcaaaacagagcctttatctgacatatagatggcgcttaagaacaggctaataaataatatgttgtcttaagttttagtttctatctgaatgttgcatgtttggtcagaatgtacttcaccttctaatatttcggctttaagttttagcttctagtatttcggcttctagtatatgtgtaataactttgagactgaatgtttggtctgaatgtttgtgtttggtctgaatgttttcagtttatggattaatgagatgagtatttgtgtttggtgaatgtttgtctcaatgttttcagtttatggattaatgagatgagtatttgtgtttggtctgaatgtttgtagtttacggttttgtttcatctgttaatgtcatgatttgcttcattttgcaggactgggaagaatagaaatggtgccaacatcaattgtggaagagaccaaatgctttaaatgtatgtattgttgtgagttttatcgattaatgagtttggtctgaacttaaccatatccattaatgactgaatgtgtgtgtttggtctgaacttaaccaaattgattaatagatgaatgtgtgtgtttggtctgaactcaaccatatcgactaatagatgaatgtgagtgtttggtctgaacttaaccattttggttacaatcgagtaatgagttttatttcatgagtttcatctattagcttatgtacttgacc

SEQ ID NO: 668 - DNA, 1015 bp, Arabidopsis thaliana
aacaatggtgcttctacttgtgattgtgggattaataagctattatgtctacaagtccataacaccgccgccaccgattccactgccggaaaatgtttccgagatatctccaagaatcaagctcaatgatggaaggcatttagcgtacaaggaattagggtttccaaaggacaaagccaaaaacaaaataataatcgtccacggaaatggaaattccaaagacgtcgatttatacatcacacaggaaatgattgatgaattcaagatatactttttgttcttcgatagagctggttatggagaaagcgatcctaatccaacacgaacgctgaaaacagatacatacgatatcgaagaacttgctgacaaattgcaagtcggtccaaagttccacgttataggcatgtcacttggagcttaccctgtttacggttgcctcaaatacattcctaataggctcagtggagcttcgttggttgttccgttagtgaatttttggtggagccgtgtgcctcaaaacttattgaatgcagcgatgaagaaattgccaattggatttcaattgacacttcgagtcgcacactactctccatggttgttatattggtggatgactcagaaatggttcccgaatagtcgaaatcccaaagatactatgaccgagcgcgacctagaactcgcggaaaagcataccaaacactcttatatcaaggagtctgctttacgacaaggtggatatgtgaccacacaacaagacatcatagcgggttacgggaattgggaatttgatccaaccgaattgaagaatccgttttcggatagtaacaaagggtcggttcatatgtggtgtgcactcgaagacaaacaaatttcacgcgatgttttactctatatatgcgataaactgccatggataaagctccatgaggtccctgatggtggacattatattatccatgagaagcggcattttgaagccattatcaaagccgcttgtagtgactagtggaagtga

SEQ ID NO: 669 - DNA, 1658 bp, Arabidopsis thaliana
acagtattgagagacttcctggtgattgattctcatgtctatgtctgagtttggcattgtctacgccatccatatcatcaccgtccaattcggctccgtcgtctcgaaagtttgtgaatgtcttctacgtaaaggacctctttcctcacgagacatctctcgtttagctgaatcagatatcaaccataacaaagttaaagatattctctatctcttgattcagcacaattgtgttcaagctttctccattgaacctcctgatggttctgagagcaaagctattgtacagtatattgtgttgtttaacaacattctgcatcgtgtgaggtataacaagttttcgaggattgtaaacgaagaacttgactccaagtgcggtgcagttcttgatggtttacttagtaacggtaggcttaccttgggacagtttattgaaagagatagagattcaggaaatacgataggttctgaagcaatcagagattctcttcagaaattggttgctgcccgttttgttgagcgcattccttctcccgaacctgttcttggaaacaaagaaaaagagccggcaaagagaagaggcgctaaagctgccaagattcttaaagaaccagaaaccttggaggaacaagttgttgaagcagcaactccagttgacgcaataaggtttccacttatattcgaagaagattccaattcatctttagcagatgacaatagcaacatcactgaggggaagcgtaaacaacgtgatgtggacacatcagattcgagcagtggagtaatttggcgtcctaattttgaggagttcatccaccgccttagacataaggcgtgtgtggagatagtgaaagagcgccgggatgaaggatgtgccattgtcttgagggcaatgttagaagtaggaagatcgcaagagaagaaggtgaaaacagacaattcggctccaatgtcagttggttccatttatgaagaagttattaagacagaagcaggtcgcactatgttacaagagcgagttgaagcatgccttgaccaattgagtgctacgtcttcttatctaccagcatttgtgaacgaagtgaatgattcatacatagttgattataaatccattatcagcgtagcacagaaagatgagatagaggcagtagtgatgagaagatatgggaaagaagctttcagaatgttcagatacttatcacaggaagggcgttttgttgagaccgataagattgctgatgccgcgctgactgaaaagaaagatacaccgcaattccttttaaagatgtggaaagacggatacttacatatgcagaaattggcggtcacagctccgggtatgtatacaccgtttctgttgtggaaggtaaacaagttgattgtgacaactcaaatgttggatgagatgtaccatgcgtcccttaacttgagtcttaggttggcccatgagttagaagccgaaaaagagttgctgttgttgccattagataaactggaaggaccattaaaggagagactgaaaaaggtcaaagccaagaggctgttactctcttccactatgtttaaacttgatgatgccattatgctttttcatgacttttaaactcatacattcaaaaactaatttcttttggtcgatttagttcacattgtct

SEQ ID NO: 670 - DNA, 1608 bp, Arabidopsis thaliana
gttttcttcgccatggcggcgattcctctcaaagctccttctcttcctggaacgagagagtgttctcccttccttaaccggttcgtcactcatcaaccggttaatttcatccggaagtttcatccttccttagatgaagcatcgttctccagacggggacgaaccactgttgttcgcgttttggagacggagaagagtacgaaaatagagaagcctgagcctccggtgaaattgattgctctcgtcggaaaaggagaagtaagcccactcaaatccacctcttgggaagaagttatgctccacactgcgagaagattgaaatgggttgatgaaggatatgaaatgctcgtctttgatgatgaaattgtgagttcaaatgatcagagagctatgaatctgacacaggaactgaatcagactgatatcttggttgtcgttgctgttaataactcagaatctgtgaattggattcagactaacagcaaaaacgtcaagaacatgatttgctttgagtcttctccaaatttgatgaacaggcttggagggactgatgttggaagtgtgaataaagataaagaagtaacagaggttgtgaagacagtgggagatgcttgggaacgtcgtaactctgatgatataaggttttgtttgctcgtgatcatcaacgcttatataagaccagttcctgtgttgcaaaacttgaggtccaaaggtttttcgacgcttagttgcatggttaaaaactgtggacctcagattttgaactgtcttttggatccgaattgtcgaaaagctcttcagtgtttgaaccaatgtagtcctgtggatcaggtgtgtagctacaggtgcattgcttcttatgagggtccttactttgaagcgttctctctttgtgtactacagaagcacaattgtttagaactggatgcaaagatccctgagaagccttatgtgcctcccatgacgagttttcgagggaaggagttgtgtcatgatacagcggaagacttgtttgttgggtggttaggggaattggaatggagctggcgtgtcgtggctggacaaaacccggcttatgatcagtttccatgtcagtaccagctattctacagagggaaagggaagtcgtcgttttggtatgagcccgtgtttcaggtcaggacgctcgaagagaagttggtgtggagaaggagaagatactcggttaagcgaggaaagatccctgcaacgtttcgtttcagtgttttggacaatggtgtggtgtcaaatgagttttggactattgtggatgtatctgatgatctaagttggggactgttccattaccatggagcagcacgtgtagcaggacagtcttacaccggagctgtgcttgtgacaccggatggttcttacccggcagagaaggacaaggagagattgcagtcagcattggagaaatgtgggattaaggaatgggaactctttgctgttgataattgttcttgtgaaaacccgccgctagggattccacagggttctagacttcattcgagaatcagtatcatagaggaaccagactcggaagaaaaattcaactaattttgcactgtggtagtcactgtttaa

SEQ ID NO: 671 - DNA, 1283 bp, Arabidopsis thaliana
ggaatcagaatcttttcagatggaggagagagaaggaactaacatcaacaacatcccaaccagttttggtctgaaacaacatgaaactcctcttcctcctcctggttacccaccacggtctgaaaaccctaatctttttccggtgggtcaatccagcacttcctccgccgccgccgcggtgaaaccttctgagaatgttgctcctccttttagcttaacaatgccggtggagaattcttcttctgagttgaagaagaagagagggagaccaagaaagtataaccctgacggctcactcgctgtgactctctctcctatgcctatctcatcctccgttccgttgacgtcggagtttggttctcggaaacgaggaagaggtcgaggaagaggcagaggaagaggacgaggacgtggacaaggacaaggaagcagagagcccaataacaacaacaacgacaacaattggctcaagaatcctcagatgttcgaatttaacaacaacactcctacttctggtggaggaggacctgctgaaattgtcagtccaagttttacacctcatgtgctcacagtaaatgccggtgaggatgtgacaatgaagataatgacattctctcaacaaggctcgcgtgctatttgtattctttcagcgaacggtcccatatccaatgttacacttcgtcaatctatgacatctggtggtactctcacttatgagggtcattttgagattctttctttgacgggttcgtttataccaagcgagagtggaggaacccgaagcagagctggtgggatgagtgtctctcttgcaggacaagatggtcgtgtctttggtggtggacttgctggtctctttattgccgctggtcctgttcaggtaatggtagggagttttatagcgggtcaggaggaatcgcagcagcagcagcagcagataaagaagcaaagaagggaaagactcgggatcccgacaacaacacaagcttctaatatctcattcggtggctcagcggaagatcctaaggctagatacgggctcaacaagcctgttgttattcagccaccaccggtgtctgcaccacctgtgtccttttcgcatgaaccaagtactaacaccgtccatggttactatgcaaataacacagctaaccatatcaaggatctcttctcttccctccctggagaagatagggaagaagatgaggatgatttagaaggtgaagatgatgaagaattcggaggccatagcgaatctgacaccgaggttccaagctgatgat

SEQ ID NO: 672 - DNA, 1805 bp, Arabidopsis thaliana
taacaacaatggagaaccctccggatcaaacagagtcaaaggagactcttcaacaacccattacaagaagaagaacaaagggtggtcttctcactatgcccttcatcattgcaaacgaggggttcgagaaagtggcgagctatggattattacagaacatgattctttatctgatgagtgattacagattgggacttgttaaaggacaaactgtcttgttcatgtgggttgctgctactaatttcatgcctctcgttggagcttttctctcagattcatatttgggtcgctttctcaccattgtcattgcttctctctccagtctcctggggatggtggttctatggctaacggcgatgttgccgcaagtaaaaccatcaccgtgtgtagcaacagccggaaccaactgcagttccgcgacatcttctcaattggctctcttgtataccgcattcgcattaatatcgattggatcaggaggaatcaggccatgttctttagcctttggtgctgatcaattggacaacaaagagaatcctaagaacgagagagttcttgagagtttctttggttggtactacgcttcttcatcagttgctgtcttgatcgctttcaccgtcattgtttacattcaagatcatctaggatggaaaatcgggtttggaatacccgcgattctcatgctgctcgcgggtttcttgtttgttttcgcgtctcctctctacgttaagcgcgatgtgagcaagagtctgttcactggtttagctcaagtggttgctgcagcttacgtgaagagaaacttaactttgccggatcatcatgactccagagattgttattaccgtttgaaagattctgaactcaaagctccaagtgacaaattgaggtttttaaacaaagcttgtgccataagtaaccgcgatgaagaccttggttctgatggtttggccttaaaccagtggaggctatgcacaacggaccaagttgagaaactcaaggcgttggtcaaggtgataccggtatggtccacggggataatgatgtcgataaacgttagccagaactcttttcagttgcttcaagctaaatcaatggacagacgtttaagcagcaattcgaccttccaaatcccagctggatcgtttggtatgttcacaatcatagccttaatctcatgggttgttctgtacgaccgcgcaattctccctttagcttcaaagatccgaggcagaccagttagagtcaatgtcaagattcgaatgggattagggctattcatatcattcttagcaatggcggtttccgcaactgttgaacattacagaaggaaaaccgcgataagccaaggactcgcaaacgatgccaactcaacagtgagcatctcagcaatgtggcttgtaccacagtatgtactacacggtttagcagaggccttgaccgggataggacagaccgagtttttctataccgagtttcctaaaagcatgtcgagtatcgcagcttcgttgttcggtctaggaatggcagtggctaatatcttggctagtgtgatcctaaatgcggtaaagaatagctcaaagcagggcaatgtgagctggattgaagataacatcaacaagggtcactatgactattactattgggttttagcgatcttgagcttcgttaatgtcatctactacgttgtgtgtagctggtcctatggtcctacggtggatcaggtgaggaatgataaggttaatggtatgagaaaagaagaagaggaagttattaaattaaactaagaccaattggttgatcattaa

SEQ ID NO: 673 - DNA, 760 bp, Arabidopsis thaliana
aacaatggatcagtctaactctctcctctcttggacatacttttcacatggaaaaactactgaggaactcagacagacattggtgtacactactatggaactcgagcagactaagttggttgctcatgaggaacttagaaaaagagatgagcagctcatccatcttgaggatgtgctcactaagactctcaaagaaagagatgaggctttggagaagtacaaccatctcctcctcaacaaccttcttctccagcaaaagcaacagcaaaaccagaaccagaagcaggaattggttactcctcctctctctggtgcttcttctatcatcgaggatgagcaggttcaacctcaacagcctcagttgaactctaacaagtctttctcttcttctgatactgaggaatctatcatgtctccatctgttatcgatcctgttactatgaaccagcagatcgaggtttcaggtgatgagatgctcgctactcttcttcctgataagcctcttcctgagaagggaaagttgctccaggctgtgattaaggctggacctcttcttcagactcttcttctcgctggaccacttcctcagtggagacatcctcctcctcctcttgagacttcagagattccaccagtgactattcctcttccacagttccagaacaacggatgcggaaactctaacaaaaagagagctttctctatctctgatgagacatactctgagacaaagtaccagaaggtgctcctccattgatga

SEQ ID NO: 674 - DNA, 1484 bp, Arabidopsis thaliana
agaaaatggcgatgcgacatttgagccgatcgagagacgttacaaagagatcgacaaagaagtacatcgaagaacctctgtacaatcgcctcttcaaagatggtggtacagaggtcaaagttcgacagcagcttaatcagttcctcaaaggcactaaacacgtcttcaaatgggaggtcggcgatacgatcaagaaactccgaaatcgcggcctctattacccagctctcaagctatctgaagttatggaagagagaggtatgaacaagacagtgagtgatcaagcaatccatcttgatcttgttgctaaagctcgtgaaattactgctggggagaattattttgttgatcttccggaaacatctaagacggaactcacgtatgggtctcttttgaactgttactgcaaggagttgttgacagagaaagcggaaggtttgctgaataagatgaaagagctcaacattactcctagttccatgtcttataacagcctcatgactctttacaccaagacaggtgagactgagaaagttccggcgatgattcaagaattgaaggcggagaatgtgatgccggattcgtacacttataatgtctggatgagggctttggctgctactaatgatatttctggtgttgagagagtcattgaagagatgaatagagatggtagagttgctccggattggactacgtatagcaatatggcatcgatatatgttgatgctggactgtctcagaaagctgagaaggctcttcaggaactggagatgaaaaacacgcaacgggattttacggcatatcagtttcttattactttgtatggacgtctggggaagctgactgaagtttacagaatttggcgttcgttgaggctggctattccgaaaacctcaaatgtagcttatctaaacatgatacaagtgctggtcaagttgaatgatttacctggtgcagagacattgttcaaggaatggcaagctaactgttctacttatgacatcaggattgtgaatgtgttgattggagcttatgctcaagagggtctaatccagaaagcaaatgagctcaaggagaaagctcccagaagaggtggaaagctcaatgctaaaacatgggagatcttcatggattactatgtaaagagcggtgatatggctcgagcactcgaatgcatgtcaaaggcagtctccatcggcaaaggagatggtggcaagtggctaccgtcacctgaaacagtcagagctttgatgagctatttcgagcaaaagaaagatgttaatggagctgagaatttgttggagattttaaagaatggaacagacaacataggcgcagaaatatttgaaccattgataagaacatatgcagcagcgggaaagagtcaccctgctatgcgacggcgcctgaagatggaaaacgtggaggttaatgaagcgacaaagaagctactcgatgaagtatctcaggatgtgtgatga

SEQ ID NO: 675 - DNA, 913 bp, Arabidopsis thaliana
aacaatgaacactaaccctgtgactaacggattcgttaagcctgttcctactgaggaagagcaggctaagatcgaggaagttagaaagctccttggacctcttcctgagaagctctcttctttctgctctgatgatgctgttctcagatacctcagagctagaaactggcatgtgaagaaagctactaagatgctcaaagaaactctcaagtggagagttcagtacaagcctgaggaaatctgttgggaggaagttgctggtgaagctgagactggaaagatctaccgttcttcttgcgtggataagctcggtagacctgtgcttatcatgagaccatctgtggagaactctaagtctgtgaagggacagatcagataccttgtgtactgcatggaaaacgctgttcagaaccttcctcctggtgaagagcaaatggtgtggatgatcgatttccatggatactcactcgctaacgtgtctctcagaactacaaaagaaactgctcatgtgctccaagagcattaccctgagagacttgctttcgctgttctctacaaccctcctaagttcttcgagcctttctggaaagttgctagacctttcctcgagcctaagactagaaacaaggtgaagttcgtgtactctgatgatcctaacactaaggtgatcatggaagagaacttcgatatggaaaagatggaactcgctttcggaggaaacgatgattctggattcaacatcgagaaacattctgagagaatgaaggaagatgataagaagagactcgcttctcttgagggaatcgtgtctgcttctctcgattctctctctatcctctctgtgtctgatggaactgcttctaactctgctcatccttcttctcatgatgtgtctgaggatgagcattgatga

SEQ ID NO: 676 - DNA, 712 bp, Arabidopsis thaliana
aacaatggatttggaagattgggagcttgttctccctaagaactctttcaaggatttggatttggatcatgatgaagatcatcatggtgctatggttatggattatttcttgtgcccttcaacaaaagatccacttcctaagactgagtcaccacctagatcaaaggtcgtgcctaagaagatcctccaggttccaattgcttgggaggctgttcttgatcaggataacactaagatccctaacaacccagatttggagcctgatcctcatcctgatcctgattctaagcctactctctctactgattctgtttcttctcctagagtgtcttttaagattatgaaggatactgagttcgctgatatgaagatcgatcctcctgctagaatcacttctcctctcccacaaattgatgatgctgcttctaagccttcagatctcgagggtggagatgatctcagagataagaaagaagtggtgctcgaagaggaagatgaggatggatctggtggagagagacttaacctctggaaagctggacttaacggaatcggagctatctgttcattcggagtggctgcagctgctgctactgtttgcgtgttcttcttgggacataacaacattaagatctgcaaaaacaaaaatcagatgctcagattccaaatctattctgatgataacaaagtgatgttcctcatctcttgatga

SEQ ID NO: 677 - DNA, 762 bp, Arabidopsis thaliana
agagaaatgttggctatcttccacgaggcgtttgctcatccgccggaggaactcaacagtccggcatctgagaaatgctctaaacaaccaaaacttccagaagaaaccctaaatgatttcttattacgttaccctctcaacactttctccatgtctttcggacaagctgctgttcttgcttacgttcgtccctctgcttccttctccatccaccagaggttgttttgtggatttgatgacatctactgtctcttctttgggagcttgaacaatctgtgtcagctaaacaaacagtatggtctcaccaagacaacaaacgaggccatgtttgtgatcgaagcttataggactcttagagacagaggtccttatccagctgatcaggtcgtcaaagacttagacggtagcttttcctttgtggtttatgatagcaaagccggctctgtcttcactgctctgggatctgatggaggggtgaagctatactggggcatagctgctgatggatctgttgttatatcagatgatttggatgttatcaaagagggttgtgctaaatcttttgctccatttcctacagggtgtatgttccatagtgaaggagggttaatgagctttgagcatccaatgaacaagatcaaggcgatgccgagggtagacagtgaaggagttctatgcggtgccaacttcaaggtggatgtgtacaatcgtgttaacagtatccctcgtcgaggaagtgaagccaattggtctctctgatga

SEQ ID NO: 678 - DNA, 929 bp, Arabidopsis thaliana
tttgaatggaaccatcatctggaaccggtcctgagaagagaccaaccgttgacttggtcaaggatagaaatggaacggatcagattcttcttcagaatcctagaggcgcctctgtaaagattagtttacatggaggacaagttctttcatggaagactgacaagggtgatgaattgttattcaacagcaccaaggccaacttgaagcctccccatccggtacgaggaggaatccctatatgctttcctcagtttggaactcggggatcacttgagcaacacgggtttgcaagaaacaagatgtggcttgtagaaaacaatccacctgctttaccttcatttgactcaactggaaaagcctatgttgatttggtgcttaagtcatctgatgaagatacgatgaggatctggccttacagctttgagtttcatctgagagtctcattggcattagatgggaacctaacactgatatcacgagtcagaaacatcaattcaaagccttttagcttttccattgcttaccacacttacttctccatttccgatattagtgaagttagacttgaagggctggaaactcttgactatcttgataatatgcatgatagagagcggttcacagagcaaggcgatgcattaacctttgaatcagagatcgatagagtgtacctaaattctaaagacgtggttgccattttcgaccatgagagaaaacgcacattcctcatcaagaaagaaggtctacctgatgtcgtggtatggaatccatgggagaagaaagcgagagcattgacggatttgggagatgatgagtatagacacatgttgtgtgtggatggagcagccattgagaaacccatcaccttgaaaccgggtgaagaatggaccgggaaattacatctctcgcttgttctttccacctaataa

SEQ ID NO: 679 - DNA, 1793 bp, Arabidopsis thaliana
ttaaaatgccggagaaaggaatgattttcccgccggtaccgagccaattggtgattttacggccaagccctcttcttcaatggcggcttggtgctcttacagcactcgtctgcttccttatgttagtcgtttggagtattgacggttgttcgattcaaagcttcgttcagccatggagattcaatgcttactctgttcgaatcagtccttctccgtcgccgtttatgtcaacgaaacccaatctagtatcagagaaacctcaccgccaaaatctcaccttgatgatggctccacgaaatctggttccgaagaagacgaatctcacttcaaactcgacccgggtccagttcgagtggataaccgctggatctcagaagaatttcacggcgaatttgatgagaggttggttggctccgggaggagcgccgtgtagagaagcgaagaccgtcgagatttcagttcccggtgtcgacgggattgattctgtggagttaaccgccggagagattcatgaattcaaatttcaagccatagacgaatctggaaaaaacgtttgcattggtggggactatttcgagactgatatatccggcgagaactggaaatcgagaccaccggtgaaagatttcggcaacggaacttactctttctctttacaggttcatcctgagttcgccggagatttcaatctcaccgtcattttactcttccgtcattaccaaggtcttaagtttagtacctcacgtttaggctttgaccgaaagcttcgcaatgttagattacgctttgttaagacgcctgacgttactctgccggagctccggtcatgtaaaaaatctgattttaacagagatgcttggtctggacgatggactaggcttgggaagaatgatgagtgtcagattagcaatgacgggcgttaccgctgcctcgctgcggatttcccttgccggaaaccgtggtgcgacggtgcggttggagctatagagagtaatggttgggtttactctagccattgctctttcaagctcttctctgcggaaaaggcttgggattgcttgaaaggcaaatggattttcttctggggagattcgaatcatgttgattcgatcagaaacttgctgaatttcgtcttgggtcatcctgaaatccccgctgtcccgaggaggttcgatatgaagttttcgaatccgaagaacccttcggagactgttaggatcacgagtatctttaacggtcattggaacgagaccaagaactatcagggccttgattcgcttaaagacagggactttagagaattgctcaagaagtacttcaacgaagaaacaaaccgtgttcccgacgtgatgatcgtgaactcgggtctacacgacgggattcactggactagtcttagagcctttgcgaaaggtgctgaaaccgcagctgcgttttggagagaagtttttgacggggtcaaaagcagaggattgcaaccgccagaagtgattttcaggaacacaatcgcgacaggcgggtacgcgagaatgctagcgtttaacccgagcaaaatggaggcgtttaacggagtgtttctcgagaaaatgagggatgcgggattggtcacgagcgtagttgataacttcgatatgacgtatccgtggcactacgataaccgttgcaacgatggagttcattacggaagagctccagcgaaaatgcggtggagggacggtgagattggacatcagtactttgtggacttgatgctcgttcacgtattgctgaatgcattgtgtgtaagatagtag

SEQ ID NO: 680 - DNA, 664 bp, Arabidopsis thaliana
aacaatggagatgaagagagatatcagagttgaagaggaaaacatgtgcacttctctcctcactgctgttgtggttttgtctatggcttgcctcaaacatttctcatcagtgtcttaccttatcgagcagtggagatctcttgttttcctcatcctcaacgttgttctcctcgctgtgtacttcacttctactagacctaacctcggaagatctcatgattttaagacaagaagaggtggtagactcagaatgatgagagaaaagaaaaacaagatcaagaagaaaaaaactagagttgtggtggagcctgcttgcttcgatcaaggattccttctcgtggagcctaaggaagttatcaagaagtgcgttctcgttgaggaaactaagagagtgtgccctaagttcgaagagacagtgaaggattgcctcttccataagaaagagatcgagtacaacggagaggaagatgagttcgaacctggtagactctctaacgaggaactcaacgagagagtggaggctttcattactactttcagacagcatctcgtgcttgatgctagaagaggaagagatagggaaacagatcaaaaaatgagacctaaggattctgattcttctttccttgtgagagaagtgacttgccttgtgtgatgagagctc

SEQ ID NO: 681 - DNA, 1721 bp, Arabidopsis thaliana
gaaacatggttgaatcggacaagtcatccgttgaagagctgaagaagagggttaggaagagaagccgtgggaagaagaatgagcagcaaaaggctgaagaaaaaacccacactgtagaggaaaacgctgatgaaacgcagaagaagagtgaaaagaaggttaagaaagtgagaggcaaaatcgaggaagaggaagaaaaggtggaagcaatggaagatggtgaagatgagaagaatattgtgattgtcgggaaagggataatgactaatgtgacttttgattccctcgacttatctgagcaaacttctatagctatcaaggagatgggctttcagtacatgacgcaaattcaagctggatcaattcagccccttttggaggggaaggatgttcttggtgctgccagaactggttctggtaaaactcttgcttttctcattccggctgttgagttgctgtttaaagagcgtttctctcctcgcaacgggactggtgtgattgttatttgccccacaagggaacttgctatccagactaaaaatgtggcggaggagttactcaagcatcattcacagacagtcagcatggttattggtggcaataacagaaggtcggaagcacaacgcattgccagtggttcaaacttggtgatagcaactcctggtcgtcttcttgaccatcttcagaatacaaaggctttcatttataaacacttgaagtgccttgtgatcgatgaagctgataggatactggaagagaattttgaggaagacatgaataagattctaaagattttaccaaagactaggcaaactgcgttattctctgccacccagacctctaaggttaaagatcttgctcgggtgtcattgacatcacctgttcatgtggatgtcgatgatggcagacgcaaggtgacaaatgaaggattggagcaaggctattgtgttgttccgagcaaacaaagacttatccttctaatttcctttttgaaaaagaacctaaataaaaagattatggtatttttctcgacttgcaagtcggtacaattccatacggaaatcatgaaaataagcgacgtggatgtctctgatattcatggaggcatggatcagaacagaagaactaaaacctttttcgacttcatgaaagcaaagaaaggtatcttgttatgtactgatgttgctgctcgtggtctcgatattccttccgtggactggattatacagtatgatccaccagacaagccaacggaatatatccatagggttggtcgaacagcccgtggagaaggagcaaagggaaaggcattacttgtcttgattcctgaagaacttcagtttattcgctacctgaaggctgcgaaagtacctgttaaagagcttgagttcaatgagaagaggcttagtaatgttcaatctgcgctggagaaatgtgttgccaaggactacaatctgaacaagttagccaaagatgcgtacagggcttatctctcagcatacaattcacactctttgaaagacatctttaatgttcaccgacttgacctcctggctgttgctgaatcgttctgcttctcttcgccgcctaaagtgaatctgaacatagaaagtggagctgggaaggtgaggaaggcgagaaagcagcaaggtcgcaatggcttcagtccttacagtccctatggcaagtccacacctacaaaggaggcataaagtgtctaa

SEQ ID NO: 682 - DNA, 1411 bp, Arabidopsis thaliana
ttagagagagatgcagaaacgggagcttgggaaatccggcggtaattccggtggatcttcgggtccaccagcgaagagaggccgtcccttcggtagtacaagtgctaactcagctgctgctgctgcagcggcggcagcagcggacgcgatgtcaccgtcagctttacttggtccttctcttctagttcacaattccttcgtcgagcagaacaatagaagaatagttcttgcgttgcagagtggtttgaagagtgaggtgacatgggcattgaacacacttacgttgctttccttcaaggaaaaagaagatattcgaagagatgtcatgcctcttgctaagatagctggcttgcttgatgcccttctcttaattatagatgattggcgtgacatagctctcccaaaggacctgacaagaggaactagagttagaactttaggtacaaatgcttcagttacgggatttggcaatgagtatgatgctctagcctctattcaaccccctggatccgggattggttcttctgctgctgaggcattaggaaaaaagagcactggtaaacatcagtcatctcagtggtggatggaagaggatggtttgtttaatctagacgatgaagggagatcagagaaacaaatgtgtgctattgctgcatcgaacgttatccgcaacttctccttcatgcctgataatgaagttgtaatggctcagcatcgccattgcttagaaactgttttccagtgcatacacgatcatatgaccgaggatgaagagctggtcacaaactcgctagagacaattgtaaacctagcgcatttgatggatcttcgaattttcagctcgcttaagcagtcatacatcaacataaatgaaaagaaagctgttcaagctgtggtcggaatcctcaattcttctgtcaaagcttggaattgtgctgctgctgagttgctagggcgtttgataatcaatccggacaatgaacctttcattagtcctttaattccgcagatacacaagcgactaatcgatcttttgagcatacaagccgttgatgcacaagctgcagctgttggagcactctacaatctcgtggaagttaacatggattgcagattaaagctagcaagtgagagatgggcggttgataggttgctgaaagtgataaagactccgcatccggttccagaagtatgtaggaaagctgcaatgatccttgagaaccttgtctcggagcctcaaaacagaggattgctactcgcgtatgagaatgctttcgctgagctgctttttcaagagggtaagtattctgattcatttgctaggattttgtatgaactcactgctagatctaatagcagagttgcttcagctagaggaatctggggcatgtaaaagtcttctctagattag

SEQ ID NO: 683 - DNA, 1000 bp, Arabidopsis thaliana
aacaatgtctctcactgagcttgatgatggactcgtgagaagaatggctatgggagctgtgttctctgatttcggaggaaagatccattctgtgggattccatagaactgatgatctcctcgtgacttcttctgaggatgattctctcagactcttcgatatcgctaacgctaaacagctcaagatcacttaccataagaaacatggaactgatagagtgtgcttcactcatcatccatcttctctcatctgctcttcaagatacaaccttgagtctactggtgaatctctcagatacctctctatgtacgataacagaatcctcagatacttcaagggacataaggatagagttgtgtctctctgcatgtctcctatcaacgattctttcatgtctggatctctcgatagatctgtgagactctgggatctcagagttaacgcttgccagggaatccttcatcttagaggtagacctgctgttgcttacgatcagcagggacttgttttcgctatcgctatggaaggtggagctgtgaagctcttcgattcaagatgctacgataagggacctttcgatactttcctcgtgggaggtgatactgctgaggtgaacgatatcaagttctctaacgatggaaagtctatgctcctcactactactaacaacaacatctacgtgctcgatgcttacagaggtgaaaagaagtgcggattctctcttgagccttctcagggaactcctatcgaggctactttcactcctgatggaaagtacgtgctctctggatctggtgatggaactctccatgcttggaacatcgaaaacccatctgaagttgctagatgggagaacaacatcggagttgtgtcttgtcttaagtgggctcctagaagagctatgttcgtggctgcttctactgttctcactttctggattcctaacgatggtgaatctcctgctcctgctgatcctccaacagatcaacagcagtgatga

SEQ ID NO: 684 - DNA, 1540 bp, Arabidopsis thaliana
aacaatggatgagagagatagagaaatcagagcttcacatggtgattctaacgctggaaacgtggtgtctcagtctatcgagaacactagagaggaagattctggatcttgcgagggattcgtggaggaatctaagagacttgagcctgagcaacagaaacatggaaagtactttttctacgatactcctctctctgaggaaactggtgtttggattcctgtttctgtgcctcctatgcttgagccagatcatgaagagtggtcaagaggactctctttcaacggtggatacttccctgaaggtgatatgggatgggatcagatcttcgatgaggataaggaactcactatgtgggatgtgatcgtggatatgcttcttgctgctagaggaaaggcttctgctctctcttctggaaaccttgagagatgcggtatcaacttcctctctggacatcttcttgagcaggcttggcaagacatggctcatactctcactgaggctaacttcggaaacgctagagagattcttgagactgagcctcctaagtggcttcctgattctgctgcttctgcttgcatgctttgctctgtgagattccatcctatcatgtgctcaagacatcattgcagatactgcggaggaatcttctgtagagattgctctaagggaaagtctcttgtgcctgtgaagttcagagtttctgatcctcagagggtttgcgatgtttgcttcgtgagacttgagtctgttcagccttacctcatggatcaagtgtctccagctgctcaacttcctactcatgatctcactgatctctcaactctcagatcttgggtgaacttcccttggggacagtctatggaatacgagatctacaaggctactaacactctcagaggttacatcacaaaagtgggatcttcaagaactgagagatctatccctgatgctatcctcagacaggctaagggacttgctgttatcactgtggctagagttggagtgatggtgacttacaagatcggaactggactcgttgttgctagaagagatgatggatcttggtctcctccttctgctatctcatctttcggacttggatggggtgctcaagcaggtggagagttcatcgatttcatcatcgtgctcagaactagagaggctatccagactttcggatctaacactcatctcgttgttggagctggactttctgctgctgttggagttactggaagagctgtggaggctgatattagagctggatctggtggatacgctgcttgctacacttactcttgctcaaagggagctttcgttggatgttctcttgagggatctatcttcactactagaacatctgagaactcaagattctacggatctcagtctcttgctgcttctgatatccttctcggatctcttcctagacctcctgctgctgctgctctttacagagctttgggagatctctatcagaaaatgggatctgagactgttagatctcctgctatctctccactttctgaggattgatga

SEQ ID NO: 685 - DNA, 1231 bp, Arabidopsis thaliana
aacaatggtgccttctaacaacagatgcaagtggagttctatcttcttgttcttgctcagtgtttctgttgctgttcttgtggctgtggctgatgataagtctcctgctgttgaggatggactcgttatcaacggtgatttcgagacttctccttcttctggattccctgatgatggtgttactgatggaccttctgatatcccttcttggaagtctaacggaactgtggagcttattaactctggacaaaagcagggtggaatgatccttatcgtgcctcaaggtagacatgctgtgagactcggaaacgatgctgagatctctcaggatctcactgttgagaagggattcgtgtactctgtgactttctctgctgctagaacttgtgctcagttggagtctatcaacgtgtctgtggcttctgttaacgctgatgctgatgatatgctcgcttcaagaaacgttgatctccagactctctactctgttcaaggatgggacccttacgcttgggctttcgaggctgaggatgaccatgttagactcgtgttcaagaaccctggaatggaagatgatcctacttgcggaccaatcattgatgatatcgctatcaagaagctcttcactcctgataagcctaaggataacgctgtgattaacggtgattttgaggatggtccttggatgttcagaaacacttctctcggagttcttctccctactaacctcgatgaggaaatctcttctctccctggatggactgttgagtctaacagagctgtgagattcgtggattcagatcatttctctgtgcctaagggaaagagagctgttgagcttctctctggaaaagagggaatcatctctcagatggtggagactaaggctgataagccttacatcctctcattctcacttggacatgctggtgataagtgcaaagaacctctcgctattatggctttcgctggagatcaggctcaaaacttccattacatggctcaggctaactcttctttcgagaaggctggactcaacttcactgctaaagctgatagaactagagtggctttctactctgtgtactacaacactagaactgatgatatgtcatctctctgcggaccagttatcgatgatgtgagagtgtggttctctggatctaagagaatcggagctggattcggattctgggttttcgttcttctcgttgtgggactcgtttgatga

SEQ ID NO: 686 - DNA, 1346 bp, Arabidopsis thaliana
catcctcatgaataattctacatcagtgaagaggctggtttcatctaaggcaatgaaatgtttctacttcagcaaagacaaaactcaggatgatgaagctaagactagaaagtttggttcagctacgatggctagaggaggatcagggtctgagtttaattcagatacaagtactgctacttccattacttcttccttgcacgtcctctcagagacacacagtaataatctcaaagtatttgtcctcgatgaccttaaaaccgctaccaagaacttcagccgctccttgatgatcggtgaaggtggctttggtggtgtctttcgtggcgtgattcagaaccctcaagattctcgtaaaaagattgatattgcagttaaacaacttagtagaagaggtctacaggggcataaagaatgggtgacagaggtaaatgtattgggagtagtggagcatccgaatctggtgaagctgatcggttattgcgctgaggatgatgagagagggatccaacggctacttgtttacgaatacgtacaaaacagaagtgttcaagaccatttatccaatcgttttatagtcactcctcttccttggtccaccagactgaagattgctcaagacactgctagaggactcgcttatcttcatcaaggcatggagtttcagatcatctttagggatttcaaatcctctaatatccttcttgatgagaactggaatgcaaaactctcggatttcggactggctcgaatgggtccttcagatggaatcactcacgtttccaccgcggttgtagggaccattggttatgcagcaccggaatacatccaaacaggacacctcacggccaagagcgacgtgtggagctacggaatctttttatatgaactcatcacaggaagacgaccttttgaccgtaaccgcccaagaaacgagcagaacatcttggagtggatcagaccacacttatccgacataaagaagttcaaaatgatcatcgacccaagacttgaaggaaactactacctcaagtcagcattaaagctagctgcagttgctaaccggtgtttgatggtaaaagcgaaagcaaggccaacaatgagtcaggtttcagagatgttagaaaggatagtggaaacatcatcagatggtgctccttcaggactgccattgatgaaaagcttgacacctaaagatgcattcgaagcctcaagaagggagagagttaagagaagatttgttgaactgttaattggagaaaatggttgtcccaatttacctacttggtctcataaacttgttacttctatttgatttttttgagagaacaaactgataatcacac

SEQ ID NO: 687 - DNA, 2240 bp, Arabidopsis thaliana
aacatgttgtttaactggactaagtaattatttatctcagcttttataagtaactttccaaaagatagtcaaaaactctcactcaatcgatggcagaaccatcttttgctcgtctgtttctcttgttcttcagctttctccttatctttgccacctactcttgggtctttggacccgactcaggcttcttgttcggtactcgtgtccggaaaactctcggctcgaatcgtcaagtccacgttgaccactctttagaaaagcctcatcatccacttgatccactaacggtgcgagaaatcaatagagtcagaacaatactctcgaaccatgacccgggttttggttccgggtcggccacgattcactccatggctctcgatgagccggagaagtcacgtgtcgtccagtggaagaagggaaataagcttctgtcacgaagagctgcggtcgtagcttattggggtggtcaaacacatgagataacggtggatcttgattcgggtcgggtagtttctgatgtgattaaccggacttcagggtatccgattctcaccttgaacgacgtcttcgctgcttcgcaggttcctttgaagagcttggaatttaaccgctccattgaagctcgtggggttaagttttccgatttagcttgcatcacaccgtttgccggatggtttggatcggaggaagaaggacgtagagtcataagagttcaatgtttcacgttacaaggcactaccaattattttatgagaccactcgaaggactttatgtaacggtcgatctagacaaattggaggttatcaagatcatcgataaaggcccaattccaattcccaaagcctccggtacagaataccggtttggtgttcagaataaaccggtgcatatggatcgtattaacccgatttcgatggagcaacctgacggtcccagttttagggtcgaagatgggcatttggttaagtgggctaattgggttttccatgttaaagctgaccaacgagccggtatgatcatatctcaggccacggttcgtgactccgagacaggtgaaccaagaagtgtgatgtacaaaggattcccatcagagttgtttgtaccgtacatggaccctgaggaaggatggtactacaaaggttatatggatgcaggcgagctcggtttaggacccacggcaatgccgctcgtgcctctcaacgattgccctcgaaattcttactatatagacggtgttttcgcctctccagacggcaaacccattgttcaacctaatatgatatgcttgtttgaacgctatgcaggcgatatcagctggcgacattctgagatcctttttgccaatgccgatataagagagtcaaggccaaaagttacattggtagctcgaatggcaacttcggttggaaattacgactatattttcgattgggagtttcagactgatggtttgatccgtgttacggtcgcggcttcgggaatgttaatggtgaaagggacaccttacgataatgtagatgacttaggtgatagggaggatgatgctggaccgttgatctctgagaatgtgattggagtcgttcatgatcatttcataacgtttcatctagacatggatattgatggaccgatgaataattctttggttaaggttcatctagagaagcagagagttccaacaggaaaatcgccaaggaagagttacttgaaggtcaagaaatatatagccaagactgagaaagatgctcagatcaagttgagcctctatgacccatatgaattccacattgtgaacccgaaccgaaaatctcgggtaggaaacccggctggttacaggatcgtaccgggtggtaatgcagcgagtttgcttgatcacgatgatcctcctcaaattcgaggtgcattcactaataatcagatatgggtgactccatataaccggtcagaacaatatgccggaggagttctaatttaccagagccaaggtgatgacacactacaagtttggtcagaccgggaccgttcgatcgaaaacaaggacatagtactgtggtacacactagggttccatcacgtaccttgtcaagaagattatccagttatgccaaccgttgcggctagctttgaacttaaaccagcaaatttctttgaatccaatccgattcttgggtctgctcctttcttcgaaaaagacttaccggtctgtagaccatttgcttcatcttgaccggttctgtaa

SEQ ID NO: 688 - DNA, 2113 bp, Arabidopsis thaliana
aacaatgattacagtagcccccttcgtgtctcttcgtttccagttccctctttatataataaatcgctccactctctttttccgagaaagaacacagtatctcgtctacaacacctgtcacattttgagaacaacggcgaaaacaatgccggtggttgctgagtacgcgaagtcgaatcggtcgtcgtgtaggtcatgttcgaacaagatagctgtgaaatcgcttaggttagggttgattagcaaaggacgtggcggggttgacatgaccaggtggcaccatttcgattgttttccgactgattctgagtcgattgcttccgttgatgatattcaaggcttatccgctttagagaaagaagatcaagatgctttgacgaaattggtggaacaatgtggtaaagtacctgcaaaaaaacctgatgagaagaaggggaaggctaaaaagcatataatggggccgaaggggcttacgaaggcggcaacatcttcaaaagttattgctgataatgcgaaatcgagcagatcatcatgcaacaggtgttctcagacaatcgtttcaaaggatctgagagtggggctggttactgaagactccaggggatttgatataacaagatggcatcacttgggttgttttcccattgattttcatccaattgattctgtggaggacattggtggatattcatcgcttgagaaaggtgaccagatggaattaaagtatttggccgaagtaaacaagaaggataaaactttgatagatgatgtccagaagatggatgaaggtgatgatgaagctatagctgataatgagctaacggaggagaccaaaaaaggaaaacattctcctgttgcaaaattggtggaacaacctggcgagcctgcaaaagaagatgaggatgaagagagtaaaaagcctgcatcagatgaaataagtgagcagaagactaaggatgtgaaaaattctcctgattcttcaaaagttatttctgagtatgcgaaatcgagcagatcaacatgcaagaagtgctctcagactatcgctgcaaaggaactgaggttggggctagtgaccagaaacttccgtggctttgatatgaaacaatggcatcacttgggttgttttcctgtcgactctgatccaattgtttcggtagaggacattggtggattttcagaactgcagagtggtgatcaggatgcattaaaggaattggtccaacaatgcgggaagcagactttggtagataagatggatgaagataatgatgacactgaagctaaaattaagctaactgaggagacaaacaaaagaaaacattctgaggttggggagatggtggaagaagatgaatcgctaactaaagcgaaacaacagatggctaaaacacataaggtgaacatgagtgagtcaacttctcaggtcgaggttgaagcagaaatcactctttcagcgtctgatgtgaaggataagtacagggatgccaatctattaccaaaatggaaagcttttgagacagttatattccttgagcgggatgatggtcttaatgattcagaaaaaatagctgcatttgactttgatggatgccttgcaaaaacatctgtgaaaatagtaggggcagatgcatggtccctaatgtatccttccattcctgagaaactgcaaagtctgcacgatcaaggctataagctggtcattttcacaaatgaatccaacattgatcgatggaagaacaagcggcaagctgctgtagattcgaaaattggacggctcaacagttttatcgagcgcgtgaaggtccccattcaggtgtttatagcctgtggagtctcaagttctggtggtaaaggtggtaaagatgacctttaccgcaaacccaaggctggaatgtggcaactcatgaagaagcattttaactctggaattgcaattgatatggataaatccttctacgttggggatgcagctggaagaaaaatggatcacagcgacgctgacatcaaatttgcacaggcgagtgggctaaagttttttaccccggaggaatactttatcccctcaagtacatcgccagggacttagctgtatcagtcttgtgcttgttag

SEQ ID NO: 689 - DNA, 994 bp, Arabidopsis thaliana
gaaagaaagagaaagcagaacatgcagggagcatgcatctccgagagtcagccatggtatctccatttcgtatgcttcataggctttctctttctccttagagtactattcattcctctcctaaaatggttcaccacaagattcctcctcacacccaagcggctcaagcggtacggctcatgggctatggtcactggagccaccgaggggatcggacgcgcctttgctcacgagctggccaaacacggccttaacctcatcctagtcagcagaaacctttcgaagctcgaatctgtctctgatgatttccaacaagagtttccccacatcaagatcaagatcattccatttgacttctcctctgaaggaggatacggagcaatcgaggaagggataaaaggccttgaagttgggattttgataaacaacgttggtattacttatccacgcgccatgttcttccacgaggttgaccaacttacatggaccaaaatcctgagggttaatcttgaagccaccacttgggtcacacgatcactcatcggaccaatgcttcaccgccgccgtggagccatcgtcaatattagctccggcgctgccgttgttgtcccttctcatcccctctacgccatctacgctgccaccaaagcttatgtggatgcactatcaagatctctacatgtggaatataagcagtttggtattgatgtccagtgccaggttcccttatacgtgtcaacaaggatggtgtcagaagtggcagctatagacaaacctagcttatttgtaccgtcgcctgaagtctacgcaaaagcggcggtggcgcagatcggaattggatcacgttgctcgccgttttgggctcattctcttcagtggtttcttgttggacttgtaccggataaccttgttgatacttggcgtctctctatcggacttcgcagaagaagtttatcttaatgatcatattttcaagtttgtatttgctcctcca

SEQ ID NO: 690 - DNA, 600 bp, Arabidopsis thaliana
gaaacttggttttgagcttaacattaaatggcggtcgtcatctccatccatcgtccttatgtaaccctcacaatctctaaaaatcgtaatcctcttaaacctcaccgacaattcaacgaatcctgcctgaggtttgatcatcttcctcggaacaccaaaaatcagctccgttgcttatctgcgaaatcgacgccatcgaaaccagaccctgcatcccctcaagatggggaagagctggagagtgtgggagtcaaagcagctttagcaatgctgagattctacaagagagagatatcgccggtgttacctagaagctgccgttacgttccgacttgcagtgaatactcaatggaagcttacaagaaatatggagttcttaaaggcactgttctcacaacttggcgtctctgtcgctgcaatcctcttggtggatctgggttcgatcctccaagatggtttggtgagagtgggatcaagctccgagaaggagacgaagaagaagaagataactatgacgacgaagatcaaagaaagatttgaatgaatttaagacaaaacagtagaagttgtacactaatactagagaaagcaatgggatga

SEQ ID NO: 691 - DNA, 771 bp, Arabidopsis thaliana
ctaattctctccgtctcgatcgcgacctctgtttcttcggcaatggcggattctcctcaaagaagaagggattcacgatctccttcaccccgaaaagaacgagctagatccagatccaggtctaggtccaggtctagatccaggcccaggcttaggtccaggtcaagatctttgccaaggcctgtttctccatcacgaagccgtggaaggtcaaggtcaagaagccgtggaagaagtgaagttgaaaaccctggtaccactctctatgtgactggcctatctacaagagtcactgacaaggatcttgaagcacatttcgccaaggaaggaaaggttgcgtcttgttttcttgtgatggagccgcgcacccgtgtgtctcgtggttttgcctttgttacaatgagcagccttaaagatgctgagcggtgcattaaatatctcaaccagtctgtactagaaggccgatacataactgtggaaaggtccaggagaaagcgcccgagaactcccaccccaggccactatcttggcttgaaaagctccagagacagcgatcgagaaggccgtagcagtcgagggaggcactatgatcgtgatgattacagagaccgtaggtcaccaagacgcgactattcacctcgtgatgaaagaaggtctagaagagatcggtcttactctcctcatggaagaagcccagagagaagatcagagagaaggtctgagaggtcagagagaaggtatgaaccccgtggctcgagatgacctgtttaa

SEQ ID NO: 692 - DNA, 887 bp, Arabidopsis thaliana
agaaaatgggagtcatgatcaatcaccatttcctcgcttttatcttcggcatcttaggaaacgtgatatccttccttgtattcctcgctccagtgccaactttttatagaatatacaagagaaaatcgacggaaagtttccagtcgctaccgtaccaagtgtcgctatttagctgcatgctatggctctactacgcattgattaagaaagacgcttttctcctaattaccatcaactcctttggctgcgtcgtggagactctctacatagccatgttcttcgcttacgccaccagggagaaaaggatatcggctatgaagttgttcatagcaatgaacgttgccttcttctcgttgattctaatggtaacacatttcgtggttaaaactcctcccctccaagtctctgtactcggctggatttgtgttgccatttctgtttctgttttcgctgcccctctaatgatcgtggctcgtgtgataaagacaaagagtgtggagtacatgcccttcacgctttctttcttcctcactataagcgccgttatgtggttcgcttatggtttattcctcaatgacatatgcatagcgattccaaacgtggtgggattcgtactagggctgttgcaaatggttttgtacttggtttacaggaactcaaatgagaaaccagagaagattaattcgtcagaacaacaacttaagagtattgtcgtgatgagtccgttaggtgtgtcggaagtgcacccagttgtgacggaatcggtggacccactctctgaagccgttcatcatgaggatctgtccaaagttactaaagtggaggagccgtcaattgaaaacggcaagtgctacgtggaggctactcgtcctgaaaccgtttgatga

SEQ ID NO: 693 - DNA, 1643 bp, Arabidopsis thaliana
acttgatgacaatgggcgactctgacctccgtaaacctaccaatttcggcaccggacatctatctcgccgacgatcatggtgttgctctttcgccgtacctccagcgagtcctgatactcgttcgatttcatctcgtaaccacattccagctaaatctcagcagcagagacctaaactggttccttgctcaccgcaaagctctaaatctgctttaaacatcgtaaatcggatcgacccgcgtcggatcttatcaccgggtcgggtttcacccatagattcggatccgaccgtcactacaatgcaagagaccgagaccactcaggaagaagaagatgatgcggttgttgtagattcgacaccaaatcttcgttctgagagttttagagctccgaagattgaggttacgggttcgggtttgagtgagggttacgatgctaggttgagtttgaagggaagaaatggtggtggggttctggtgttggagcttagcttggaggttttggctgcgaattctgatgtgttctcgggtttgattgcggaggagaagaagtgttcttcttcttcatcgtctttaggattgaagaacacatgcaggattgaagtatgtgatgtggagaatcttggtgtttttagggaaactgttgagctcatgtttgaggaaagtaatgttattatcaagaagtttatgacaatgggagtctacagagccattgatgtacttgaggtagcggctggaatcaaattttcaagagctgtcttatcgtgtctgaaatatcttgaagctgttccttggacagaggatgaagaggaaaaactgaggagacttcttggaatttatagctttgatgatgatgcagttagtgaaattttggcaagatttaattcaaacgagacagaaaacttgcaagacagtttatcgaagaaactggtttggtcaattacttcctgcagtgatgtaaatcctagaaacgagctcaaatctctggtgaagggtcttctttgcaaaagctcagtgtacgagaaagaacagcctgagatcaacaaggaagacatatatagagcaggcaagtgttgtgtggattcattagctaagttgtttgaagagggcagtagtagtagtagtagcaagaaagaaaagccattgattgaaagtatttcgagggaggttgagaacataaactggctgctggagatcatgatagatcgggaaatagcagaagaatttgtggaaatatgggggaagcaaagaaggctagtggagatgcatgagagagtgtcaccaatggtgaggtatgaagtaagcagagtaacaggagcgatatttattgcaatggggaaaaggagagtgcaatgcggaggagaagcaagggcggggctagtagaagcgtggttcaagccaatgttagtagattttgggtggctacagagatgcaagaaaggactagacatgagggaagtagaagaagggatggggcaaacgcttttaacgctaccagtaaaagagcagtatcaagtgttcatggaatggttcaggtggttctcaaagcatgggactgagtgccctaatctcagcaaggcgtttcagatatggtggcgtaggtcattccttagaggtgtagaatcatctacttgtaggtaataa

SEQ ID NO: 694 - DNA, 946 bp, Arabidopsis thaliana
tctcaatggcttctaattaccgttttgccatcttcctcactctctttttcgccaccgctggtttctccgccgccgcgttggtcgaggagcagccgcttgttatgaaataccacaacggagttctgttgaaaggtaacatcacagtcaatctcgtatggtacgggaaattcacaccgatccaacggtccgtaatcgtcgatttcatccactcgctaaactccaaagacgttgcatcttccgccgcagttccttccgttgcttcgtggtggaagacgacggagaaatacaaaggtggctcttcaacactcgtcgtcgggaaacagcttctactcgagaactatcctctcggaaaatctctcaaaaatccttacctccgtgctttatccaccaaacttaacggcggtctccgttccataaccgtcgttctaacggcgaaagatgttaccgtcgaaagattctgtatgagccggtgcgggactcacggatcctccggttcgaatccccgtcgcgcagctaacggcgcggcttacgtatgggtcgggaactccgagacgcagtgccctggatattgcgcgtggccgtttcaccagccgatttacggaccacaaacgccgccgttagtagcgcctaacggtgacgttggagttgacggaatgattataaaccttgccacacttctagctaacaccgtgacgaatccgtttaataacggatattaccaaggcccaccaactgcaccgcttgaagctgtgtctgcttgtcctggtatattcgggtcaggttcttatccgggttacgcgggtcgggtacttgttgacaaaacaaccgggtctagttacaacgctcgtggactcgccggtaggaaatatctattgccggcgatgtgggatccgcagagttcgacgtgcaagactctggtttgatccaagggatgtgagtaagacac

SEQ ID NO: 695 - DNA, 1247 bp, Solanum lycopersicum
ctataatggctggaatgtgttgtggagttaatatagccgaaactgaggctactacaccagttgagcctagttcagaatctgcgaggagaagaagaatggaaattcatcaattccgttttgtacctaccgatgttgcagctgcaacacaggaaaaaaatggacggaaaaggcataagattgacaaagttattgataataacaagaggcagaaattggaaagcagtgtaacgatttcgttggcggtaactgatgaaaggaatgaaaatgaagtgttggatctgtctgaatctggttctcaatctgttgaaattgagcctgatttacccaaatatgggatgacttctgtatgtggaagaagaagagatatggaagatgcggtttcgattcatcctttgttttgcaaagagaatagtgaaaactcaagcaatttacatttcttcggtgtttatgatggccatggctgttctcatgtggcgatgaagtgtaaagatcgaatgcacgagatagtgaaaaatgaggtggagaaggaagaaactcaatggaaagaagcaatgattcagagcttttcgttaatggataaagaagttgttaattattctactagcgtacttccatcttctacctcaggttccaattgtagatgcgagcttcaaactccacagtgcgatgccgttggatcaactgccgtcgttgccgttgtaactccggacaaaatcatcgtttccaattgcggtgattctcgtgccgtcctctgtagaaacggcgtcgctattcctctttccgttgatcataagccggatcgacctgatgaattgaatagaatacaagaagctggtggccgtgttatatattgggacggagctagagttctcggcgttttagcaatgtctcgagccattggtgacaattatttgaaaccatatgttatatctgaaccggaggtcactataacagatcgaaccgacgaagatgagtgtttgatattagccagtgatggattatgggacgtggtatcgaacgagaccgcgtgtggcgtggcacgtatgtgtttgcaatcgagacggccaccgtctccggcgggatcgccgggaaatgatattacggtgaccggcgccggagaaagctccgacaaggcgtgttcagatgcatcaattctattgacgaaattagccttggctaggcatagtagtgataatgttagtgttgttgtggtggatttgagaaaaaatctataacagtatgggtaa

SEQ ID NO: 696 - DNA, 584 bp, Arabidopsis thaliana
aaacaatggcgaataagttcactagacaacagatttcagagtttagggaacagttcagcgtatacgacaagaatggtgatggtcacattaccacagaggagttcggtgccgtgatgcgttccctcggtttaaacctgacccaagctgagcttcaggaggagatcaacgattcggatttagatggtgacggaaccatcaatttcactgagttcttgtgcgcaatggctaaggacacttactctgagaaagacctcaagaaagatttcagactctttgacatagacaagaatggtttcatctcagctgctgaaatgagatatgtgaggactatcctccggtggaagcaaactgatgaagaaatcgatgagattatcaaggcagctgatgttgatggtgatggtcagatcaactacagagagtttgccaggcttatgatggccaagaatcaaggtcatgatactaaatatgacacaactggtggcactttggagagggacttggcggccggggttgccaaaaatatcatcgcagcgccaatgaccgacttcatcaaaaatttgttcgaagcgttgttttcttgatga

SEQ ID NO: 697 - DNA, 1586 bp, Arabidopsis thaliana
caaatatgactgtgatgaatcaccgacacaagcaatgtcattttctcctcctccttctgatcactgtcttctctgccgcgttggatggtgtttcttccgagacagacgtcggagggtttgactacggtgaagcattgtctaaaagcttactctactttgaagctcagagatcaggaagacttccgtacaaccagcgcgtgacttggcgtgatcactctggtctcaccgatggtcttgaacaaggggttgatttagtgggaggatatcacgacgccggagaccatgttaaatttggacttccgatggcttttacggtgacaatgttgtcatggagtgtaatagagtacggtgactcactcgcttccaccggagagttatctcacgcgcttgaagccatcaagtggggaacagactacttcatcaaggcacacacaagcccaaatgtcttatgggccgaagttggcgacggtgacactgaccactactgttggcaaagaccggaggacatgacgacttcacggagagctttcaagatcgatgagaataatccgggatcagatatcgctggagaaactgcggcggctatggcggcagcttcgatcgttttccgttcaacaaatccacattactctcaccttctcttgcaccatgcccaacaattgtttgagtttggagacaagtacagaggaaaatacgatgagagtctaaaagttgtgaaaagttattatgcctcggtgagtgggtacatggacgagcttttatggggtgccacttggctttatcgagccaccgacaatgagcactatatgagttatgtggttgacatggctcaccaactaggtggcctttcttgggccatgtccgagtttagctgggacgtcaagttcgccggtgttcaactcctagcttccatgttgctaaaagaagaaaagcacaagcaacattctaaagtcctacaacaatacaaatcaaaggcggatcattacctatgctcaattctcaacaagaacatcaacggcacaaacgtccagcgaactcctgccggtttactctacgtccgacaatggaacaatatgcaatacgtatccacagcatctttcctcctaaccgtatattctgatcatctccgaaaatcaaacaccgatctcgagtgtcacgaaggaaccgtaactcctgacgagatgcttggctttgcgaaatctcaaatcgattacattttaggatcaaatccaatggaaacaagttatctagtcgggtacggtccaaaatacccgattagggttcatcatcgaggcgcgtctatcgcttcttttaaagagcacaaaggttttataggatgtactcaaggatatgataattggtatggacggtccgagccaaatccgagtgttttagtcggggctttggttggaggaccggatcaccaggatgattttgatgaccggaggggtaattacgttcaaacggaggcttgtacgtacaatactgctcctttggtcggtgtgtttgcgagacttatagagcttgaggagcaaaaacttgaagaagaagatgtgagcttggttgcaacttataagagatagtag

SEQ ID NO: 698 - DNA, 662 bp, Arabidopsis thaliana
ctgcaatggcttctcctcttctcccaacttcgactactcctgatcaacttcccggcggcgatccacagttgctgagctctctacgcgtcctcttgtcccgcgttctagccaccgtccgtcacgcttctgcagatgccagaccctgggcagagctcgttgaccggtcagcgttttcccggccaccatcgctctcggaggcaacgtcacgagtaaggaagaacttttcctatttccgagccaattacataaccttagtggcaatcttactcgccgcgtctctgctcacgcaccctttcgctctcttcctcctcgcatcgctggccgcttcttggcttttcctctactttttccgtccggcggatcagccgttggtcattggaggacgcacgttctccgatcttgagacgctagggatactctgcctgtccactgtggtggtgatgttcatgaccagcgttggatcgctcttgatgtccactctagcagttgggatcatgggcgtggccatccacggagcgtttcgtgctcccgaagacctgtttcttgaagaacaagaagccattggatctggacttttcgcattcttcaacaacaatgcctctaatgcagctgccgctgccatagccacctcagcaatgtcacgcgttcgagtctgagattga

SEQ ID NO: 699 - DNA, 750 bp, Arabidopsis thaliana
aggaaaatgacagaatcgagtctggatctgcaggaatctggttgggaagaacttaggcgggaagctcgtaaaattgaaggagatctagacgttaagctctcttcttacgctaagctaggcgccaggtttactcaaggcgggtatgttgacactgggtctccaaccgttggatcggggagatcatggaagtctatggagatggaaattcaatcgttgcttgagaagttgttggatattaatgattccatgagtagatgtgctgcatctgctgcacccacaacatcggttactcaaaaactagcaaggcacagggatatacttcatgaatatacccaggagtttcgaagaataaaaggaaatataaactcgttgagagaacacgctgagcttctgagttctgtcagggatgacataagtgaatataaggcttctggtagtatgtcaccaggtgtgcaagtgttaagggagagagcttcaatccatggaagtatatcccatattgatgatgtgattggtcaagctcaagcgacaagagcagttcttggctctcaacgatctctgttttcagatgttcaagggaaagtaaaaaatctcggagacaaattcccagtgattcgtggcttacttggctcaattaaaaggaaacgttctcgggacacacttatcctctccgctgtcatcgctgcttgtacgttgtttctaatcatctactggctctcaaaataaacagaatgttcatacacctaagct

SEQ ID NO: 700 - DNA, 1451 bp, Arabidopsis thaliana
tccaattccatcttcccatggcgatttcggctccagccgcttgttcttcctcctctagaattctctgttcctactcctctccttctccttctctctgtcccgccatttccacctctggtaaactcaaaaccctaactctctcttcctccttcctcccttcttactcattaaccaccacctccgcttctcaatccactcgtcgctccttcaccgtccgcgccgctcgtggaaagttcgagaggaagaagcctcatgtcaacatcggaaccatcggtcatgttgaccatgggaaaactactttaaccgcagctctaaccatggctctcgcttccattggttccagcgtcgctaaaaagtacgacgagattgacgctgcgccggaggagagagctcgtggtatcacaatcaacactgctactgttgagtacgagactgagaatcgtcactacgctcacgttgattgtcctggtcacgctgattacgttaagaatatgattaccggagctgcacagatggacggagctatcctcgttgtttccggcgccgatggtcctatgcctcagactaaagagcatatccttttggctaagcaggttggtgttcctgatatggttgtgtttcttaacaaagaggatcaagtagatgatgcagagttgctagagctcgttgagcttgaggttcgtgagcttctctcgtcttatgaatttaacggtgatgatattccgattatctctggttctgctcttttagccgttgagactcttactgagaatcctaaggttaagagaggtgataacaaatgggtagataagatttatgaacttatggatgctgttgatgattacatccctatccctcagagacaaactgaattgccattcttgttagctgttgaggatgtgttctctatcactggacgtggtacggtggctacagggcgtgtcgagagaggtacggttaaggtaggagagactgtagatttagtgggtttgagggagactaggagttacactgtcactggggttgaaatgtttcagaagattcttgatgaggctttagctggtgacaatgtagggttgttgcttaggggtattcaaaaggctgatattcagagaggtatggttttagctaagccgggatcgattactccacataccaagtttgaagcaattatctatgtgttgaagaaagaggaaggtggaaggcattctccattctttgcagggtacaggcctcagttctacatgaggacgactgatgttacgggtaaagtgacgaagatcatgaacgacaaagatgaagagtcgaagatggttatgcccggtgatcgagtgaagattgttgttgagcttattgtgccggtggcttgtgaacaagggatgaggtttgctatcagagaaggaggaaagactgttggtgctggagttattgggacgatcctcgaatgatga

SEQ ID NO: 701 - DNA, 1676 bp, Arabidopsis thaliana
ggataatggcttcgtatggtgagtgactagtttcttatacaacgttttctggtgtgaagcaatatggacactgtgttaggattctttaaggcttcgatgatgtagtgcagatttaaaaattgggactttaccataaagcgtgtggattgatttgatattggtaatgggtttattgatttattttgatgaattgaatctttttaatggttgcaggcgaggagcgtgaaatccaaaagaattactggaaagagcattcagtgggattgagtgttgaagctatgatgcttgattccaaagcttctgacctcgacaaagaagaacgtcctgagatacttgcgtttcttccacctattgaagggacaacagtgctagagtttggtgctggaattggtcgttttactactgaattagctcagaaggccggccaggtcattgcggttgacttcattgaaagtgttatcaaaaagaatgagaacattaacggtcactacaagaacgtcaaatttctgtgcgctgatgtcacatcaccaaatatgaactttccaaatgagtctatggatctgatattctccaactggctgctaatgtatctctctgatcaagaggttgaagatttggcgaaaaagatgttacaatggacaaaggttggcgggtatattttctttcgggagtcttgtttccatcagtctggtgataacaagcggaagtacaacccaacacactaccgtgaacctaaattttacacaaagcttttcaaagaatgccatatgaatgacgaagatgggaattcgtatgaactctctttggttagctgtaaatgcattggagcttatgtgagaaacaaaaagaaccagaaccagatatgctggctttggcagaaagtcagttcggataatgataggggcttccaacgcttcttggacaatgtccagtataagtctagtggtatcttacgctatgagcgtgtctttggagaagggtttgttagcacagggggactcgagacaacaaaggaattcgtggatatgctggatctgaaacctggccaaaaagttctagacgttgggtgcggaataggaggaggggacttctacatggctgagaactttgacgtggatgttgtgggcattgatctatctgtaaacatgatctcttttgcgcttgaacacgcaataggactcaaatgctctgtagaattcgaagtagctgattgcaccaagaaggagtatcctgataacacctttgatgttatttatagcagagacaccattctacatatccaagacaagccagcattgttcagaagattctacaaatggttgaagccgggagggaaagttctcatcactgattactgcagaagccccaaaaccccatctccagactttgcaatctacatcaagaaacgaggttatgatcttcatgatgtacaagcatacggtcagatgctgagagatgctggtttcgaggaggtaatcgcggaggatagaaccgatcagttcatgaaagtcctgaaacgggaactggatgcagtggagaaggagaaggaagaattcatcagtgacttctcgaaagaggattacgaggatattataggcgggtggaagtcaaagctacttaggagctcaagtggtgagcagaagtggggtttgttcatcgccaagagaaactgataa

SEQ ID NO: 702 - DNA, 824 bp, Arabidopsis thaliana
tagccatggacaacgaaggcataggtctttacccgcttcatcgttgcaaaaccattcacctggtgagacatgctcaagggattcataatgtggctggtgaaaaagatcacagtgcttactcttcggaggattactttgatgctcatcttacccctcttggttggcaacaggttgataatctaaggaaccatgttcgtgcagctcaactcttaaacaaggttgaacttgtcattgtttcccctatgcttagaactatacaaacagctgttggtgcttttggaggagaagaagatactaatggagcggatgcaacaccgttaatggtggctaatgctgggagcagcgatcgtcctgcgatttctagcttaaatagtcctcctttccttgctgttgagctttgcagggaaactatgggtgatcatccttgtgacaggcgaagaagcgtcactgagtacaaggctctctttcccgctattgatttctcaattattgaaaccgacaatgatgttctgtggaagccgagtccaagagagagccttgaagaagttgcagccagaggtgtagagttcatcaaatggatatggacaaggaaagagaaggagatcgcaattgtatctcacagtggcttcttgcacggtctcttgagttctttcgggaaggattgttgcgatgacctaaagaaagagttgtctatacatttgagcaactgtgagcttcgctcaatggttatcgtggatcgagggaacctggggactgactctgcagagaccacaaactatcctgggaaggttcctgaaggacttgataatcctagtggctaataa

SEQ ID NO: 703 - DNA, 772 bp, Arabidopsis thaliana
tccgatcatgccgaccagaaacatcgccattggtggagtccaagaagaggtctatcaccccaacgcacttagggcggcgctcgctgagtttatctcgactttgatcttcgtcttcgccggctcaggctccggaattgctttcaacaagatcactgacaatggagcaaccactccttccggcctcgtcgccgctgccttagctcatgctttcggtctctttgtcgctgtctctgttggcgctaacatttccggtggccacgttaaccctgccgttaccttcggtgtcttactcggtggtaacatcactctcctccgtggtattctctactggattgctcagcttcttggctccgtcgccgcttgtttcctccttagctttgccaccggtggcgagccaattccagcgttcggtctctctgccggagtcggatcattaaacgctctcgtcttcgagatcgtgatgaccttcgggctcgtctacaccgtctacgccacagccgttgaccccaagaacggtagtctcggaacaatcgcaccaatcgccataggtttcatcgttggagctaacatcctcgccggtggagctttcagcggagcttccatgaacccagccgttgctttcggaccagccgtcgtaagctggacgtggaccaaccactgggtttactgggctggtcctcttattggtggtggactcgccggaattatctacgactttgtcttcatcgatgaaaatgcccacgagcaattgcctaccaccgattactgataa

SEQ ID NO: 704 - DNA, 892 bp, Arabidopsis thaliana
cgagagagacagagaggtttcgatggcgaggaacgggattgggagttcaggagggaagaagaatggggctgggcagtttttcttagcgacgctgcttctttggcttgtctccgtcgtgtttgagattgctttcaatctccggacggagcttctctgggtgatttgcggtggatgcttctttcaattgatgaattgggttgttcgttcatggatttctcgtgaccctatatttgttaatacctctgtctcgcttttgcactcaatcatcacctccgcatcagtggttttcatacttctcaatcaatgcttagccaaaggtttagacgagatgtttgatcattctgagttggttggtgggacttggaaatgggcatatccagctttgtgtttctcatgcggctactttgcatatgaccagtgggatatgcttcagtaccggttatacagcggcttaataccttctattcttgttcaccatctagtcctccttgtttgcttcacattggcactataccgaaatgtaaccatcaactaccttattcttactctcatctgtgagatgcattcgatctttctacacgtgaggaagctaaggagaatggcaggaatccgagacagcaacacagcattggtgaaactggagtgggtattaaactggacagcctttgtgtttgcgagatgcattcctcacattctcatcactatcaagctgatcaaagacgcacacaagtttgggaaaggcgtggagttaccactcgctctgtctggtatggcaggaatgaacattcttaatgttggcctcgggttggatctgtttcatgctttcagaagagagagaagccacagaagaaaccaagagaacggcaaccttcacgaccatggagaataataa

SEQ ID NO: 705 - DNA, 362 bp, Oryza sativa
ccaggatgaagttcatttctgcctatctgatggcctatctggctggcaactccagccccactgcggaggatttgacaacgattctggagtcagttggttgtgaaatcgacaatgcaaagatggaactcctgttgtctcaagtgagtggcaaggacatcactgagctcatcgcttgtggcagggagaagtttgcttcagttccatctggtggtggtggtgtagctgttgctgctgctgctcctgctgccggtggtgctggtggtgctcctgcagctgaggcgaagaaagaagataaggtcgaagagaaggaagaaagtgatgatgacatgggcttcagtttgtttgactgagtgatgcgatga

SEQ ID NO: 706 - DNA, 272 bp, Oryza sativa
ggcgaatggctggatttcgggattacaacagaaaaattgtgaaactggaatgggtcctcaactggactacatttgtatcagcaagggtggcatgccacatactgattacatacaaactgatcattgatgcccacaagtttgatagtggaattgagcttccactagctctttttggcatggcaggaatgaatctgctcaacatatttttaggacttgatctattaaaagcttacacgctcgagagaaatcagcagacacatcaggactgataa

SEQ ID NO: 707 - protein, 514 aa, Oryza sativa
MESEMAAVGSTLTMERVATAKKFIENHYRSQMKNIQERKERRFRLERQLESSQVPREQQINLLKDLERKETEYMRLKRHKICVDDFELLTIIGRGAFGEVRLCREKTSSNIYAMKKLKKSDMVVRGQVEHVRAERNLLAEVASHCIVKLYYSFQDSEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSFSETTNGRRWRSQHEQLQHWQMNRRKLAFSTVGTPDYIAPEVLLKKGYGMECDWWSLGAIMYEMLVGYPPFYSDDPITTCRKIVHWRNHLKFPEDSKVSPEARDLICRLLCDVDHRIGSAGADQIKAHPWFRGVAWEKLYEMEAAFKPQVNDELDTQNFMKFEEMDNAPTRTGSGPSRKMMLNSKDLSFVGYTYKNFDAVKGLKHSDQQRNQSLIRPSIGSIFGPADMDPSREPNGRDKHMHTVSSGDPMIQ

SEQ ID NO: 708 - protein, 182 aa, Brassica napus
MRKLKFHEKKIIRKTNFLEWKREGGHRENLITTRYHMGGRDDYKKYSGLCRMVQKLTNVMKQMDPTDPFRIQMTDLLLEKLYNMGVIPTRKSLALTDRLSVSSFCRRRLSTVLVHLKYAEHLTEAVTYIEQGHIRVGPDTITDPAFLVTRNMEDFITWVDSSKIKRKVLQYNDKLDDYDMLA

SEQ ID NO: 709 - protein, 328 aa, Brassica napus
MTSDALNIPSELESALRLRTVQYFITKRPWLDLYGVHVRPVAPFGSTSSKPQFDPALIHRSLPDELLFEVFARMLPYDLGRAACVCRKWRYTVRNPVFWRNACLKAWQTAGVIENYRILQSKYDGSWRKMWLLRSRVRTDGIYVSRNTYIRAGIAEWKITNPVHIVCYFRYIRFYPSGRFLYKNSSQKLKDVAKYMIFKSSKADGLYRGTYTLSMTDDKIEAAVLYPGTRPTVLRIRLRLRGTAIGANNRMDLLSLVTSGVNDEEGSSTEEDILGVVENWRDDETHNPDIPAVSHKRGMTPFVFVPFEEVEQSVLNLPPEKMDYFVTG

SEQ ID NO: 710 - protein, 202 aa, Brassica napus
MQVVSPLSPATRFVGEESFAELYGKLNADFSSKLKVGFTNEEEEKNRDDNKSWWNQDDDDDEREEGEEDEEFSFTSLNADNSPITADEAFEDGQIRPVYPLFNRNLLFEPEERDLRSPLKKLFVESEEAATTEREEESEPMGPYCSWSGRTVVEEASPETCRKSSSTGFSKLWRFKDLVSRSNSDGKDAFVFLNHGDKKKQS

SEQ ID NO: 711 - protein, 41 aa, Arabidopsis thaliana
HDLLHFAGLGRIEMVPTSIVEETKCFKCMYCCEFYRLMSLV

SEQ ID NO: 712 - protein, 230 aa, Arabidopsis thaliana
MDLEDWELVLPKNSFKDLDLDHDEDHHGAMVMDYFLCPSTKDPLPKTESPPRSKVVPKKILQVPIAWEAVLDQDNTKIPNNPDLEPDPHPDPDSKPTLSTDSVSSPRVSFKIMKDTEFADMKIDPPARITSPLPQIDDAASKPSDLEGGDDLRDKKEVVLEEEDEDGSGGERLNLWKAGLNGIGAICSFGVAAAAATVCVFFLGHNNIKICKNKNQMLRFQIYSDDNKVM

SEQ ID NO: 713 - protein, 360 aa, Solanum lycopersicum
MAGMCCGVNIAETEATTPVEPSSESARRRRMEIHQFRFVPTDVAAATQEKNGRKRHKIDKVIDNNKRQKLESSVTISLAVTDERNENEVLDLSESGSQSVEIEPDLPKYGMTSVCGRRRDMEDAVSIHPLFCKENSENSSNLHFFGVYDGHGCSHVAMKCKDRMHEIVKNEVEKEETQWKEAMIQSFSLMDKEVVNYSTSVLPSSTSGSNCRCELQTPQCDAVGSTAVVAVVTPDKIIVSNCGDSRAVLCRNGVAIPLSVDHKPDRPDELNRIQEAGGRVIYWDGARVLGVLAMSRAIGDNYLKPYVISEPEVTITDRTDEDECLILASDGLWDVVSNETACGVARMCLQSRRPPSPAGS

SEQ ID NO: 714 - protein, 489 aa, Arabidopsis thaliana
MVAGEEREIQKNYWKEHSVGLSVEAMMLDSKASDLDKEERPEILAFLPPIEGTTVLEFGAGIGRFTTELAQKAGQVIAVDFIESVIKKNENINGHYKNVKFLCADVTSPNMNFPNESMDLIFSNWLLMYLSDQEVEDLAKKMLQWTKVGGYIFFRESCFHQSGDNKRKYNPTHYREPKFYTKLFKECHMNDEDGNSYELSLVSCKCIGAYVRNKKNQNQICWLWQKVSSDNDRGFQRFLDNVQYKSSGILRYERVFGEGFVSTGGLETTKEFVDMLDLKPGQKVLDVGCGIGGGDFYMAENFDVDVVGIDLSVNMISFALEHAIGLKCSVEFEVADCTKKEYPDNTFDVIYSRDTILHIQDKPALFRRFYKWLKPGGKVLITDYCRSPKTPSPDFAIYIKKRGYDLHDVQAYGQMLRDAGFEEVIAEDRTDQFMKVLKRELDAVEKEKEEFISDFSKEDYEDIIGGWKSKLLRSSSGEQKWGLFIAKRN

SEQ ID NO: 715 - protein, 87 aa, Oryza sativa
MAGFRDYNRKIVKLEWVLNWTTFVSARVACHILITYKLIIDAHKFDSGIELPLALFGMAGMNLLNIFLGLDLLKAYTLERNQQTHQD

SEQ ID NO: 716 - DNA, 1596 bp, Solanum lycopersicum
ataaataaatatatacatcacatttttttctccaatttttttgtttttccattctataatggctggaatgtgttgtggagttaatatagccgaaactgaggctactacaccagttgagcctagttcagaatctgcgaggagaagaagaatggaaattcatcaattccgttttgtacctaccgatgttgcagctgcaacacaggaaaaaaatggacggaaaaggcataagattgacaaagttattgataataacaagaggcagaaattggaaagcagtgtaacgatttcgttggcggtaactgatgaaaggaatgaaaatgaagtgttggatctgtctgaatctggttctcaatctgttgaaattgagcctgatttacccaaatatgggatgacttctgtatgtggaagaagaagagatatggaagatgcggtttcgattcatcctttgttttgcaaagagaatagtgaaaactcaagcaatttacatttcttcggtgtttatgatggccatggctgttctcatgtggcgatgaagtgtaaagatcgaatgcacgagatagtgaaaaatgaggtggagaaggaagaaactcaatggaaagaagcaatgattcagagcttttcgttaatggataaagaagttgttaattattctactagcgtacttccatcttctacctcaggttccaattgtagatgcgagcttcaaactccacagtgcgatgccgttggatcaactgccgtcgttgccgttgtaactccggacaaaatcatcgtttccaattgcggtgattctcgtgccgtcctctgtagaaacggcgtcgctattcctctttccgttgatcataagccggatcgacctgatgaattgaatagaatacaagaagctggtggccgtgttatatattgggacggagctagagttctcggcgttttagcaatgtctcgagccattggtgacaattatttgaaaccatatgttatatctgaaccggaggtcactataacagatcgaaccaacgaagatgagtgtttgatattagccagtgatggattatgggacgtggtatcgaacgagaccgcgtgtggcgtggcacgtatgtgtttgcaatcgagacggccaccgtctccggcgggatcgccgggaaatgatattacggtgaccggcgccggagaaagctccgacaaggcgtgttcagatgcatcaattctattgacgaaattagccttggctaggcatagtagtgataatgttagtgttgttgtggtggatttgagaaaaaatctataacagtatgggtgcttaattagtactagttttaatcataattaattaattaagtgtataattaaggggaaactctaattttaggttttaattgtcatgggtttagctaatgaagctaagattgaagatggtttgatttattagtttagctgatttagctgcctttgttgatgattagtattgctaattattattattgttattattatatattttagagaaatggagatgagaaattgtaaagaagtggatcttttttccaactgtcccagattttatgtgaaatatagaaaatacaaaatcatattttt

SEQ ID NO: 717 - DNA, 1153 bp, Arabidopsis thaliana
cgcaaaagcacatgtgatagtagccgacagtttgaagtaaagccagcaaatcgtgaaagccatttacttttagatctctctctgcactctctgactttgtccgcaaagtagatctgctgcaatggcttctcctcttctcccaacttcgactactcctgatcaacttcccggcggcgatccacagttgctgagctctctacgcgtcctcttgtcccgcgttctagccaccgtccgtcacgcttctgcagatgccagaccctgggcagagctcgttgaccggtcagcgttttcccggccaccatcgctctcggaggcaacgtcacgagtaaggaagaacttttcctatttccgagccaattacataaccttagtggcaatcttactcgccgcgtctctgctcacgcaccctttcgctctcttcctcctcgcatcgctggccgcttcttggcttttcctctactttttccgtccggcggatcagccgttggtcattggaggacgcacgttctccgatcttgagacgctagggatactctgcctgtccactgtggtggtgatgttcatgaccagcgttggatcgctcttgatgtccactctagcagttgggatcatgggcgtggccatccacggagcgtttcgtgctcccgaagacctgtttcttgaagaacaagaagccattggatctggacttttcgcattcttcaacaacaatgcctctaatgcagctgccgctgccatagccacctcagcaatgtcacgcgttcgagtctgagattgttgaagagactacattcctacaccgcatttccaaagtgtgatatttattcatattgaattgttgtaacttgtaaccattcttttgtcatttctgttttgtttactttgttgctggaattttgaaacacaattcatcttactatacaccattaaaacgagagtcagtaaagaagaattttactaactctctcttgttttttgacaccaaagtaaaaaagatacgacaaattggtttaagctcaaaaccatgaatcgaagaataagaataaattacactgtgctctcatgttaagagctctctctatcgtattgccttgtttcctcagcaacctttgtccacacattggcgatcttctctgcatatccaacctgcaca

SEQ ID NO: 718 - DNA, 1154 bp, Arabidopsis thaliana
ttttatctataactatcaagaagaagaaaacactcggctatatatatacgtacaacacataagaaaaccaaaccaatcacttcactctctctaatcaaaaagcttttaacctcagccgttaaatctttctccgatcatgccgaccagaaacatcgccattggtggagtccaagaagaggtctaccaccccaacgcacttagggcggcgctcgctgagtttatctcgactttgatcttcgtcttcgccggatcaggctccggaattgctttcaacaagatcactgacaatggagccaccactccttccggcctcgtcgccgctgccttagctcatgctttcggtctctttgtcgctgtctctgttggcgctaacatttccggtggccacgttaaccctgccgttaccttcggtgtcttactcggtggtaacatcactctcctccgtggtattctctactggattgctcagcttcttggctccgtcgccgcttgtttcctccttagctttgccaccggtggcgagccaatcccagcgttcggtctctctgccggagtcagatcattaaacgctctcgtcttcgagatcgtgatgaccttcgggctcgtctacaccgtctacgccacagccgttgaccccaagaacggtagtctcggaacaatcgcaccaatcgccataggtttcatcgttggagctaacatcctcgccggtggagctttcagcggagcttccatgaacccagccgttgctttcggaccagccgtcgtaagctggacgtggaccaaccactgggtttactgggctggtcctcttattggtggtggactcgccggaattatctacgactttgtcttcatcgatgaaaatgcccacgagcaattgcctaccaccgattactgaagacgtcaaattcaacgttgttaatctgatgaatttttcgtgatttgcttttttaatttgcatcgtaatgggtttctggccgttggatcatttttagatgaatctttgtctattgattgatcatttatgtgtctttgggtttgttgttggagttgtaatatctctggaaggcttttgtgcaattgtattgtacggtttaataactataattgagaaaaccagggaatgtgaattatgaaaatgaatttttttgtta

SEQ ID NO: 719 - protein, 564 aa, Arabidopsis thaliana
HKTVISQTTTLLTSPALSHLMTMGDSDLRKPTNFGTGHLSRRRSWCCSFAVPPASPDTRSISSRNHIPAKSQQQRPKLVPCSPQSSKSALNIVNRIDPRRILSPGRVSPIDSDPTVTTMQETETTQEEEDDAVVVDSTPNLRSESFRAPKIEVTGSGLSEGYDARLSLKGRNGGGVLVLELSLEVLAANSDVFSGLIAEEKKCSSSSSSLGLKNTCRIEVCDVENLGVFRETVELMFEESNVIIKKFMTMGVYRAIDVLEVAAGIKFSRAVLSCLKYLEAVPWTEDEEEKLRRLLGIYSFDDDAVSEILARFNSNETENLQDSLSKKLVWSITSCSDVNPRNELKSLVKGLLCKSSVYEKEQPEINKEDIYRAGKCCVDSLAKLFEEGSSSSSSKKEKPLIESISREVENINWLLEIMIDREIAEEFVEIWGKQRRLVEMHERVSPMVRYEVSRVTGAIFIAMGKRRVQCGGEARAGLVEAWFKPMLVDFGWLQRCKKGLDMREVEEGMGQTLLTLPVKEQYQVFMEWFRWFSKHGTECPNLSKAFQIWWRRSFLRGVESSTCR

SEQ ID NO: 720 - protein, 253 aa, Arabidopsis thaliana
MPTRNIAIGGVQEEVYHPNALRAALAEFISTLIFVFAGSGSGIAFNKITDNGATTPSGLVAAALAHAFGLFVAVSVGANISGGHVNPAVTFGVLLGGNITLLRGILYWIAQLLGSVAACFLLSFATGGEPIPAFGLSAGVRSLNALVFEIVMTFGLVYTVYATAVDPKNGSLGTIAPIAIGFIVGANILAGGAFSGASMNPAVAFGPAVVSWTWTNHWVYWAGPLIGGGLAGIIYDFVFIDENAHEQLPTTDY

SEQ ID NO: 721 - protein, 145 aa, Oryza sativa
FTAETLELTLARRRRSHLRRRSSGSLHLPSRMKFISAYLMAYLAGNSSPTAEDLTTILESVGCEIDNAKMELLLSQVSGKDITELIACGREKFASVPSGGGGVAVAAAAPAAGGAGGAPAAEAKKEDKVEEKEESDDDMGFSLFD

SEQ ID NO: 722 - protein, 306 aa, Oryza sativa
ARLAEGGEEGTESIVRCGSPLATTTTSPMPPPPHRGGGGGRDTSAFFAATLVLWAVSVGFEIGARGRRELAPVAAGFAFFQAASAAVRAAVSRDPLFVNTAVSLLHSSLTSASVIFVLVNRWHNKDLKNMFEHEELFGGSWVGAYSALCFSCGYFAYDQLDMLRYRLYSGRIPGILMHHLILLICFTLALYRNVTINYLILTLVCELHSVFLHIRKLRRMAGFRDYNRKIVKLEWVLNWTTFVSARVACHILITYKLIIDAHKFDSGIELPLALFGMAGMNLLNIFLGLDLLKAYTLERNQQTHQD

SEQ ID NO: 723 - protein, 586 aa, Oryza sativa
GGGTNNSSSRLDSHRGSEKKRGERKKNTSEATRGWVVVAAAAMESEMADAAPAPAVAAAATAEPLAAVAEEGEEGGEAAVGSTLTMERVAAAKKFIENHYRSQMKNIQERKERRFRLERQLESSQVPREQQINLLKDLERKETEYMRLKRHKICVDDFELLTIIGRGAFGEVRLCREKTSSNIYAMKKLKKSDMVVRGQVEHVRAERNLLAEVASHCIVKLYYSFQDSEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSFSETTNGRRWRSQHEQLQHWQMNRRKLAFSTVGTPDYIAPEVLLKKGYGMECDWWSLGAIMYEMLVGYPPFYSDDPITTCRKIVHWRNHLKFPEDSKVSPEARDLICRLLCDVDHRIGSAGADQIKAHPWFRGVAWEKLYEMEAAFKPQVNDELDTQNFMKFEEMDNAPTRTGSGPSRKMMLNSKDLSFVGYTYKNFDAVKGLKHSDQQRNQSLIRPSIGSIFGPADMDPSREPNGRDKHMHTVSSGDPMIQ

SEQ ID NO: 724 - DNA, 584 bp, Brassica napus
cggcacgaggggtctcttctcagatactcattcacagaaagaaaccatgaccgtcgtctctctgttagtcgccttcaccgttgttgcactctgtttacactcttcaacatctgagttcctgaagtttcagctttccaccatatcagctgcacctacgtttttgcctgaagctccttcgagtttctcagcttcacctccggaggctatgtctccagatatatctcctctgttccctactccaggttcaagcgaaacgtctccttctccgtcagaatcttttgacatcccgacaatcccctcgagccttagtccaccaaatccagatgccgtctctcctgatcctctgcttgactcttctcccgtggggtctcctcttcctgcttcttcctctgtttctctggtctcgtcaccactctctctgcttctggccttccccatgttaatgctagctttctgcagattctaataaattattttgaaacagagtaagagagtaagccctctttgacatcttgcttgaagaaaaagattcacaatgtattctttttactctatgcttgtttatgaaactttatttttcttgt

SEQ ID NO: 725 - DNA, 557 bp, Brassica napus; identical to SEQ ID NO: 659

SEQ ID NO: 726 - DNA, 805 bp, Brassica napus
  misc_feature (761)..(761): n is a, c, g, or t
tttaatcctctctgcggcgtagggttttagcataaacctcgccgcatccttgcgccgcattctccccgatttcgcgttgtttgcaccaccttgagaaggctcagtgatgaggaagctcaagaaccatgagaagaaggttctgaagaaagtaaatttcttggaatggaaaagggaaggcggccatcgcgaaaccctgatcacgggtcgttaccacatgggtggtcgtgacgattacaaaaaatattcaggattgtgtaggatggtgcagaagctgacgaacgtgttgaaacagatggatgcaactgatccttttcgtattcagatgactgatacgcttctcgagaagctatacaacatgggagttataccgactaggaaaagcttggctttaactgatcggttatcagtttcctccttctgtcgtcgtaggctatcgactgtgttggttcacctgaagtacgcagagcacttgacagaagcagtgacgtacatagagcaaggacacatccgtgtaggaccagacacgatcaccgatccagccttcttagtgacgcggaacatggaagatttcatcacctgggttgattcttccaagatcaaacgcaaggtgcttcaatacaacgacaagttggatgactacgacatgcttgcttaaaagatatctcacttctcaaagtgtgtaaaccttttctattaccaaactatgtttctcatttagtttcagaaattaggacaagaaaacaaagattcaatcaaaagtnctttgacatctgaatccctttattaaccaacccacatttctcgt

SEQ ID NO: 727 - DNA, 995 bp, Brassica napus; identical to SEQ ID NO: 660

SEQ ID NO: 728 - DNA, 1311 bp, Brassica napus
  misc_feature (434)..(434): n is a, c, g, or t
ggtcctgtttcttattttttcggtaacagaggagcgcggctacgaaaccgctctcgaattcctttttcattcggaacatcacccaattctctagcaatttccacatgacttcagatgctctcaacataccatccgagcttgaatctgcgttacggctcaggacggtacagtactttatcacaaagaggccttggcttgatctctatggagtccatgtaaggcccgtggcaccattcggaagcacaagcagtaaaccacaatttgatcctgctttgattcatcgctccttgcctgatgagcttcttttcgaggtgtttgctcggatgttgccttatgaccttggcagagcagcttgtgtctgcagaaagtggaggtacactgttcgcaaccctgtcttctggcgtaacgcctgcttgaaagcttggcagactgcnggggttatcgaaaactataggatcttgcagtctaaatacgatggatcatggaggaaaatgtggcttcttagatccagagttcgtactgatggtatttatgtgagtaggaacacttacattcgagctggaattgctgagtggaagattacaaatccagttcacattgtatgttacttccgctacataagattctacccttctggcaggtttctttacaagaactcttcgcagaagttgaaggatgttgccaaatacatgatctttaagtcttctaaagcagacggtctttacagaggcacttacacattgtcaatgacagatgacaagatcgaagcagctgttctgtatccagggacgcgccctactgtcttaaggatccgtttaaggttaagaggaacggcgattggagcgaataacaggatggatttgctgtcactagtgacgagtggtgtgaacgacgaggaaggaggtagcacagaggaggacattcttggggtagttgagaattggagagacgacgagactcacaatccggatatacctgccgtctcacacaagaggggtatgactcccttcgtcttcgtcccgttcgaagaggttgaacaatcggtcttgaacttacctccagagaaaatggattactttgtcaccggctagagtgacacatcaaccaacgcctatctcaatgtacaaagaacataatatatcaatgtagaatataatgtatgcatgttttgcttgattattatgacaacaacattactagtgtctctgtttgttggtgttacacgccaaatgttgacattttgttgtttacataaacatgaaagaaggcttaataatgtaaaaaaaaaaaaacctatagtgagtcgtatta

SEQ ID NO: 729 - DNA, 818 bp, Brassica napus; identical to SEQ ID NO: 661

SEQ ID NO: 730 - DNA, 1041 bp, Brassica napus
cggacgcgtgggttttttttccgtttcagtttttcttttttcaagaaagagagaaactctgtgtgtttgtatttatttggatctaattgttaaaaaagatgcaagttgtttctcctttatctccggcgacgagattcgtcggagaagagagcttcgccgagctttacggcaaactaaacgctgacttcagctcgaaactgaaggtcggttttacaaacgaggaagaagaaaagaacagagatgacaacaagtcttggtggaatcaagatgatgatgatgatgagagagaagaaggagaagaagatgaagagttctcgttcacgagcttaaacgcagataactcaccgataaccgcagacgaagccttcgaagacggtcagatccgaccggtttatccactctttaaccggaatctcctcttcgaaccggaagagagagatctccgctcgcctctcaagaagctcttcgtggagagcgaggaagccgccaccaccgaaagggaggaagaatctgagccgatcggtccttattgctcgtggtcaggtagaacggtggaggaagcttcgccgaagacttgtcggaaaagtaactcaacgggattctcgaagctttggaggtttagagatcttgtcctgagaagcaaaagcgacggtaaagacgcgtttgtgtttcttagcaacggttcttcgtcgcagtcgtctccttctacgacggcggcggcggcggcgaaaccgagcggcgtgaagagagcggagaaggcgaagatgaaaacgaagtcggcacacgagaggctgtacatgaggaacagagcgataagggaagaagggaaacggagatcgtatcttccgtacaaacatgtcgggttcttcaccaatgtcaatggtcttacaaggaatgttcatccttactgatcatcaccttcttgttgctcagacaaaactttgatttcgtacatagttaaaaatctaaccatgtcttaataccattataataaccctttttctctaagcaaaaaaaaaaaacctatagtgagtcgtatta

SEQ ID NO: 731 - DNA, 513 bp, Arabidopsis thaliana
ctccgtcgacgataccaaaggcgattcagcttgatttgtttgatccaacgttttgatcatgaaatcgggagagcaaccacatatactcaatatacaaccgccggaatgatgatcgacgatgagattgttcaccaagtcaacttcaaaccggatcttgtggttatattgttcaattctttgtaacaccaggagcttctatcatgtggctatctcatgagctcttaccaagaggactgggaagaatagaaatggtgccaacatcaattgtggaagagaccaaatgctttaaatgtatgtattgttgtgagttttatcgattaatgagtttggtctgaacttaaccatatccattaatgactgaatgtgtgtgtttggtctgaacttaaccaaattgattaatagatgaatgtgtgtgtttggtctgaactcaaccatatcgactaatagatgaatgtgagtgtttggtctgaacttaaccattttggttacaatcgagtaatgagttttatttca

SEQ ID NO: 732 - DNA, 1091 bp, Arabidopsis thaliana
atggtgcttctacttgtgattgtgggattaataagctattatgtctacaagtccataacaccgccgccaccgattccactgccggaaaatgtttccgagatatctccaagaatcaagctcaatgatggaaggcatttagcgtacaaggaattagggtttccaaaggacaaagccaaaaacaaaataataatcgtccacggaaatggaaattccaaagacgtcgatttatacatcacacaggaaatgattgatgaattcaagatatactttttgttcttcgatagagctggttatggagaaagcgatcctaatccaacacgaacgctgaaaacagatacatacgatatcgaagaacttgctgacaaattgcaagtcggtccaaagttccacgttataggcatgtcacttggagcttaccctgtttacggttgcctcaaatacattcctaataggctcagtggagcttcgttggttgttccgttagtgaatttttggtggagccgtgtgcctcaaaacttattgaatgcagcgatgaagaaattgccaattggatttcaattgacacttcgagtcgcacactactctccatggttgttatattggtggatgactcagaaatggttcccgaatagtcgaaatcccaaagatactatgaccgagcgcgacctagaactcgcggaaaagcataccaaacactcttatatcaaggagtctgctttacgacaaggtggatatgtgaccacacaacaagacatcatagcgggttacgggaattgggaatttgatccaaccgaattgaagaatccgttttcggatagtaacaaagggtcggttcatatgtggtgtgcactcgaagacaaacaaatttcacgcgatgttttactctatatatgcgataaactgccatggataaagctccatgaggtccctgatggtggacattatattatccatgagaagcggcattttgaagccattatcaaagccgcttgtagtgactagtggaagatacattataacaaaaaaaaactctaaaagatttgtatctaaaatcagtttaagaaaaattatggctatgtaagtttcatgtg

SEQ ID NO: 733 - DNA, 1740 bp, Arabidopsis thaliana
ctgaatcttacgtcctctggatctttcttctctctctctctctcttgtctatactttaagtgtctgtctgaagaagcttgaatctgtcgtgatcatcaagattcaagttctgtctttttgagtctttttcttctacttctattgagtttctcttccttaattgtcggaatcagaatcttttcagatggaggagagagaaggaactaacatcaacaacatcccaaccagttttggtctgaaacaacatgaaactcctcttcctcctcctggttacccaccacggtctgaaaaccctaatctttttccggtgggtcaatccagcacttcctccgccgccgccgcggtgaaaccttctgagaatgttgctcctccttttagcttaacaatgccggtggagaattcttcttctgagttgaagaagaagagagggagaccaagaaagtataaccctgacggctcactcgctgtgactctctctcctatgcctatctcatcctccgttccgttgacgtcggagtttggttctcggaaacgaggaagaggtcgaggaagaggcagaggaagaggacgaggacgtggacaaggacaaggaagcagagagcccaataacaacaacaacgacaacaattggctcaagaatcctcagatgttcgaatttaacaacaacactcctacttctggtggaggaggacctgctgaaattgtcagtccaagttttacacctcatgtgctcacagtaaatgccggtgaggatgtgacaatgaagataatgacattctctcaacaaggctcgcgtgctatttgtattctttcagcgaacggtcccatatccaatgttacacttcgtcaatctatgacatctggtggtactctcacttatgagggtcattttgagattctttctttgacgggttcgtttataccaagcgagagtggaggaacccgaagcagagctggtgggatgagtgtctctcttgcaggacaagatggtcgtgtctttggtggtggacttgctggtctctttattgccgctggtcctgttcaggtaatggtagggagttttatagcgggtcaggaggaatcgcagcagcagcagcagcagataaagaagcaaagaagggaaagactcgggatcccgacaacaacacaagcttctaatatctcattcggtggctcagcggaagatcctaaggctagatacgggctcaacaagcctgttgttattcagccaccaccggtgtctgcaccacctgtgtccttttcgcatgaaccaagtactaacaccgtccatggttactatgcaaataacacagctaaccatatcaaggatctcttctcttccctccctggagaagatagggaagaagatgaggatgatttagaaggtgaagatgatgaagaattcggaggccatagcgaatctgacaccgaggttccaagctgatgatcgatggaaagaatccgacatatatgtgttatgaatcttgagttgttttatttcggtgtcttcagatttttttagagcgtaatggtattttttttctttcagattgttagttgttaaagtcttaaacagagatatttcactaaaagttagggtttactagaggatgtaatctttagggttctttgacttgtgtctttcttttaatcctcagatggttgttgtaggcttgtagccaatcttagtgtgtgttcaaactctctccttcaatcaaactccccaatgacttcattttg

SEQ ID NO: 734 - DNA, 2079 bp, Arabidopsis thaliana
gtcgcagaaaacagagattcctcgctgtctgaactgaaaaataagatcgcattaactcaaaactctcacaaagacaaagatcttctcctccttctcttctctttttcacttttctctcttcccctctctcgaagcttgaaaggtaacaacaatggagaaccctccggatcaaacagagtcaaaggagactcttcaacaacccattacaagaagaagaacaaagggtggtcttctcactatgcccttcatcattgcaaacgaggggttcgagaaagtggcgagctatggattattacagaacatgattctttatctgatgagtgattacagattgggacttgttaaaggacaaactgtcttgttcatgtgggttgctgctactaatttcatgcctctcgttggagcttttctctcagattcatatttgggtcgctttctcaccattgtcattgcttctctctccagtctcctggggatggtggttctatggctaacggcgatgttgccgcaagtaaaaccatcaccgtgtgtagcaacagccggaaccaactgcagttccgcgacatcttctcaattggctctcttgtataccgcattcgcattaatatcgattggatcaggaggaatcaggccatgttctttagcctttggtgctgatcaattggacaacaaagagaatcctaagaacgagagagttcttgagagtttctttggttggtactacgcttcttcatcagttgctgtcttgatcgctttcaccgtcattgtttacattcaagatcatctaggatggaaaatcgggtttggaatacccgcgattctcatgctgctcgcgggtttcttgtttgttttcgcgtctcctctctacgttaagcgcgatgtgagcaagagtctgttcactggtttagctcaagtggttgctgcagcttacgtgaagagaaacttaactttgccggatcatcatgactccagagattgttattaccgtttgaaagattctgaactcaaagctccaagtgacaaattgaggtttttaaacaaagcttgtgccataagtaaccgcgatgaagaccttggttctgatggtttggccttaaaccagtggaggctatgcacaacggaccaagttgagaaactcaaggcgttggtcaaggtgataccggtatggtccacggggataatgatgtcgataaacgttagccagaactcttttcagttgcttcaagctaaatcaatggacagacgtttaagcagcaattcgaccttccaaatcccagctggatcgtttggtatgttcacaatcatagccttaatctcatgggttgttctgtacgaccgcgcaattctccctttagcttcaaagatccgaggcagaccagttagagtcaatgtcaagattcgaatgggattagggctattcatatcattcttagcaatggcggtttccgcaactgttgaacattacagaaggaaaaccgcgataagccaaggactcgcaaacgatgccaactcaacagtgagcatctcagcaatgtggcttgtaccacagtatgtactacacggtttagcagaggccttgaccgggataggacagaccgagtttttctataccgagtttcctaaaagcatgtcgagtatcgcagcttcgttgttcggtctaggaatggcagtggctaatatcttggctagtgtgatcctaaatgcggtaaagaatagctcaaagcagggcaatgtgagctggattgaagataacatcaacaagggtcactatgactattactattgggttttagcgatcttgagcttcgttaatgtcatctactacgttgtgtgtagctggtcctatggtcctacggtggatcaggtgaggaatgataaggttaatggtatgagaaaagaagaagaggaagttattaaattaaactaagaccaattggttgatcataattaaatggtgtacgtgtgttataaaattctatatatttgtatgtaattagattattatatcatggatttggattttcttaggatgtagaggttgatgttaattaatgggtcgtgtgtttatttaattattac

SEQ ID NO: 735 - DNA, 1733 bp, Arabidopsis thaliana
catttctctagctttacatagtcaccattttttttgtttgtttgacctcaaaaactcctacgtttctaagctcttctctttgcttcgattcccaaaacgactatttccaaaagggtttaaagaagttatgaacactaatccagtgactaatgggtttgttaaacctgttcctactgaagaagaacaagcaaagattgaggaagtgaggaagctattaggtccattaccggagaagctttcgagtttttgttccgatgatgcagttttaaggtatctaagggcaaggaattggcatgtcaagaaagctactaagatgcttaaagaaactttgaaatggagagttcaatacaaacctgaggagatttgttgggaggaagtagctggtgaagcagagacagggaagatatatagatcgagttgtgtcgataaacttggacgacctgttctcattatgagaccgagtgttgagaattctaaatcggtgaaaggccagattagataccttgtgtattgtatggagaatgcagtacaaaatttgccaccaggggaagaacagatggtgtggatgatagattttcacggttatagtttggcgaatgtatcgttacgaacaacgaaagaaaccgctcatgtattacaagaacattaccctgagagattagcttttgctgttctctacaatcctcctaagttctttgaacctttctggaaggtggcgcggcccttcttagagccgaagacacggaacaaagtgaagtttgtttactcggatgatccaaacactaaggtgataatggaggagaactttgatatggagaaaatggagttagcgtttggtggtaacgatgactcgggttttaacatagagaaacattcagagagaatgaaagaggacgacaagaaaagattggcttcgttggagggcattgtttccgcttctctagactcgctcagcattttatcggtctctgatggtaccgcctctaacagtgctcaccctagctctcatgatgtctctgaggatgagcattaaccacagagaaaggactcatcaaatgtttgtaacttcaagcacacttggaataaatctaattccacttcatgaggttgtagctgcaaccattgtatgttttcgaaacctattctccaccgcgatgagattcaatatgtatttttttcgcgatgagattcaatatgtatttttttcgattagtaataaaaccgtcacagataaaatgcacataacacaagctgcaatacattttaataccacatacttaacaaaacagagaaactagtcctcggtttcttggtatagcttcatgatatccgcacaacccggcatagctgcatcccttagaaatcccatgttgttagcaaaacggtcgtcagaagcaataccgttgaagcgagtgagagtcacacgggcacggtcatgaccaggggacacattggaacaccgtaactgagagctacgaaccaacattgcatcacagaactgctcatcatgatcctcgttaaccaagatcttgtatgatcctgtcgagtcagttctcgcctcgtggctatacgttaactccattgttctcctgtctttacattccaatctaaccactgcacctatattattcatagctggagtttcgaaaccagcgaggcaagtgtcgcaatagacacggcctcgcacgacgaaagggttcttgttcggtctagccgcgatggctagagccggt

SEQ ID NO: 736 - DNA, 1137 bp, Arabidopsis thaliana
aatcaattcattactttttataccacacggcacacgcgttatcaaagcatattgtgttgcttcgtttaagaaacgaaattagggtctcaatcttatttctcttaattattattattaatccaaacattctcagaactagtttgaatcttttattaaaggatcttgagaccccttcacatgggagagagaaagaaagagagatagcgagagatgttactccatgagaataccaaacccacttcgctctaataattcaaaagatttcactttctcaaacaaaaaaacttctctctttcttttctaatttctaaaaccctaattgaagttccaacaagatcgatcaaggagaagatggatctcgaggattgggaattagtactccccaagaacagcttcaaggatcttgatcttgatcatgacgaggatcatcatggagccatggtgatggactacttcctctgcccatctactaaagatcctctccccaagacagagtctcctccaagatccaaagtggtccctaaaaagattcttcaagttcccatagcttgggaagccgtgttggatcaagacaacacgaagatacccaataaccctgatcttgaaccggatccgcatccggatccggattcaaaaccgaccctttcgacggactctgtttcgtcaccaagagtttccttcaagatcatgaaggacactgaatttgccgacatgaaaattgacccaccagcgaggatcacgagtcctctgcctcagatcgatgatgctgcttcgaaaccctctgatttagaaggaggggatgacttgcgagacaagaaagaagttgttttggaggaagaagatgaagatggtagtggtggtgagagattgaatctgtggaaggctggtctcaatgggattggagcaatctgttcttttggggttgcagctgctgctgctaccgtatgtgtcttcttcctcggacacaacaatatcaaaatctgtaagaacaagaaccagatgcttcggttccagatttactccgatgataataaggtaatgttcttaattagttaaatgaatttattttatttttctttatgatatatctttgaatgttctcagttaaataatttaatgaaaaattattggttttat

SEQ ID NO: 737 - DNA, 1141 bp, Arabidopsis thaliana
tgatcgcatccaaaacgtttttccttcccacaggaaaagaagaaaaacagacagcggaggactaaaacaactagccacaacacaacgcttcaaatatatattactctgccactttcttcaatcttccttcaaagattcttattacagcgacacacaactcttttccatttagatttttgattttttttggttctctaaaggaggagagaaatgttggctatcttccacgaggcgtttgctcatccgccggaggaactcaacagtccggcatctgagaaatgctctaaacaaccaaaacttccagaagaaaccctaaatgatttcttattacgttaccctctcaacactttctccatgtctttcggacaagctgctgttcttgcttacgttcgtccctctgcttccttctccatccaccagaggttgttttgtggatttgatgacatctactgtctcttctttgggagcttgaacaatctgtgtcagctaaacaaacagtatggtctcaccaagacaacaaacgaggccatgtttgtgatcgaagcttataggactcttagagacagaggtccttatccagctgatcaggtcgtcaaagacttagacggtagcttttcctttgtggtttatgatagcaaagccggctctgtcttcactgctctgggatctgatggaggggtgaagctatactggggcatagctgctgatggatctgttgttatatcagatgatttggatgttatcaaagagggttgtgctaaatcttttgctccatttcctacagggtgtatgttccatagtgaaggagggttaatgagctttgagcatccaatgaacaagatcaaggcgatgccgagggtagacagtgaaggagttctatgcggtgccaacttcaaggtggatgtgtacaatcgtgttaacagtatccctcgtcgaggaagtgaagccaattggtctctctgaatacttttaataacactttcaatttggtttctttttcgcacttgtgcttcttctccgctttcatcttagttatggactgttcctaagcttgccatgaataaaactgtgaataataaagcttttaatgttctgtttcttactttaagtcagacaataaacttttaacacttgtgatcat

SEQ ID NO: 738 - DNA, 919 bp, Arabidopsis thaliana
tataagaatcgatcggaggaaggagaaaagaaacagagcaaagtagagagatatagagagaacaatggagatgaagagagacattagagtggaggaagagaacatgtgtacttcattgttgactgcagttgttgttctttcaatggcttgtcttaaacacttctcttctgtatcgtatttgatcgagcaatggcgttcgttggtgtttcttatactcaacgtcgttctcttagccgtttactttacctcgactcgtcctaacctcgggaggagtcatgatttcaagactcgtcgaggaggtagattgagaatgatgcgagagaaaaagaataagattaagaagaagaagacaagggtggtggtggaaccggcttgttttgaccaaggtttcttacttgttgagccaaaggaagtgatcaagaagtgtgttttagtggaggagacgaaaagagtttgccctaaatttgaggaaactgtgaaagattgcttgtttcacaagaaagaaatagagtataatggagaagaagatgaatttgagccagggaggttatccaatgaggagttgaacgagagagttgaagcgttcatcacgacgtttagacaacatttggtgctagatgcgagacgaggtagagacagagaaactgatcagaagatgagaccaaaagactctgacagtagctttttagttcgggaagtcacttgtttggtttaagagtttctctctacaatctttttttcatcttaagattcgttcggttttgttcgttctttggcttcgtttcttttgtgagtttgagctaatagctcaaaagatcgcatcttctttttttgatgtaatgccataagaacacaaaagtatattcaaaaaatttacataacaacaaaaaatcgaaaatataatcttcttcgaaatttt

SEQ ID NO: 739 - DNA, 3020 bp, Arabidopsis thaliana
ataacctaaaccaattgcatggttagaataaattagtaaaatatctcatagatgcgatcaagcgtacaggactttgaaaagcgttaattattgtttatttcttatttaacatgttgtttaactggactaagtaattatttatctcagcttttataagtaactttccaaaagatagtcaaaaactctcactcaatcgatggcagaaccatcttttgctcgtctgtttctcttgttcttcagctttctccttatctttgccacctactcttgggtctttggacccgactcaggcttcttgttcggtactcgtgtccggaaaactctcggctcgaatcgtcaagtccacgttgaccactctttagaaaagcctcatcatccacttgatccactaacggtgcgagaaatcaatagagtcagaacaatactctcgaaccatgacccgggttttggttccgggtcggccacgattcactccatggctctcgatgagccggagaagtcacgtgtcgtccagtggaagaagggaaataagcttctgtcacgaagagctgcggtcgtagcttattggggtggtcaaacacatgagataacggtggatcttgattcgggtcgggtagtttctgatgtgattaaccggacttcagggtatccgattctcaccttgaacgacgtcttcgctgcttcgcaggttcctttgaagagcttggaatttaaccgctccattgaagctcgtggggttaagttttccgatttagcttgcatcacaccgtttgccggatggtttggatcggaggaagaaggacgtagagtcataagagttcaatgtttcacgttacaaggcactaccaattattttatgagaccactcgaaggactttatgtaacggtcgatctagacaaattggaggttatcaagatcatcgataaaggcccaattccaattcccaaagcctccggtacagaataccggtttggtgttcagaataaaccggtgcatatggatcgtattaacccgatttcgatggagcaacctgacggtcccagttttagggtcgaagatgggcatttggttaagtgggctaattgggttttccatgttaaagctgaccaacgagccggtatgatcatatctcaggccacggttcgtgactccgagacaggtgaaccaagaagtgtgatgtacaaaggattcccatcagagttgtttgtaccgtacatggaccctgaggaaggatggtactacaaaggttatatggatgcaggcgagctcggtttaggacccacggcaatgccgctcgtgcctctcaacgattgccctcgaaattcttactatatagacggtgttttcgcctctccagacggcaaacccattgttcaacctaatatgatatgcttgtttgaacgctatgcaggcgatatcagctggcgacattctgagatcctttttgccaatgccgatataagagagtcaaggccaaaagttacattggtagctcgaatggcaacttcggttggaaattacgactatattttcgattgggagtttcagactgatggtttgatccgtgttacggtcgcggcttcgggaatgttaatggtgaaagggacaccttacgataatgtagatgacttaggtgatagggaggatgatgctggaccgttgatctctgagaatgtgattggagtcgttcatgatcatttcataacgtttcatctagacatggatattgatggaccgatgaataattctttggttaaggttcatctagagaagcagagagttccaacaggaaaatcgccaaggaagagttacttgaaggtcaagaaatatatagccaagactgagaaagatgctcagatcaagttgagcctctatgacccatatgaattccacattgtgaacccgaaccgaaaatctcgggtaggaaacccggctggttacaggatcgtaccgggtggtaatgcagcgagtttgcttgatcacgatgatcctcctcaaattcgaggtgcattcactaataatcagatatgggtgactccatataaccggtcagaacaatatgccggaggagttctaatttaccagagccaaggtgatgacacactacaagtttggtcagaccgggaccgttcgatcgaaaacaaggacatagtactgtggtacacactagggttccatcacgtaccttgtcaagaagattatccagttatgccaaccgttgcggctagctttgaacttaaaccagcaaatttctttgaatccaatccgattcttgggtctgctcctttcttcgaaaaagacttaccggtctgtagaccatttgcttcatcttgaccggttctgttctgactaatactctaatagtatacaagtagagaagatcaaatatccggtgtagccaaacacttgttgaagtttatttgccggtttttgcaataataacaaaacgtccaatatctgtaatccccgacgtaacataataccaaaaatcttcagtttcttcagagagaagttgttcgtgttcgagttattgtagagccagcatacgggctgttgctttgttgagtttgcttctcttaacgaagcagagaaggcgttggaaacgaagaagggtgaaactttttacagtcgtaagattattcttgacgtggctgagatggctccagaccctttccgactcaagtacaaccttgtaaagaagctttgttaccaagactttcaacaagaaagaccggaaagacagcagataaaatccctgttctgcggtaagaagactatcatctcttctgacgactgatagaagctcctttggtgttttttagttgtgatatctattccagttacgaagaccttcaatgcaagtatgcaactgtgctttgttacttcgttttttcttttcttcttgttaagtttttgtcttaattaaattaaaatatgcttaatttttagttatttacctaaataattaaaatatgcgaattgaactgatttggtaaataaataattaaaatcacaatca

SEQ ID NO: 740 - DNA, 1070 bp, Arabidopsis thaliana
atgcagggagcatgcatctccgagagtcagccatggtatctccatttcgtatgcttcataggctttctctttctccttagagtactattcattcctctcctaaaatggttcaccacaagattcctcctcacacccaagcggctcaagcggtacggctcatgggctatggtcactggagccaccgaggggatcggacgcgcctttgctcacgagctggccaaacacggccttaacctcatcctagtcagcagaaacctttcgaagctcgaatctgtctctgatgatttccaacaagagtttccccacatcaagatcaagatcattccatttgacttctcctctgaaggaggatacggagcaatcgaggaagggataaaaggccttgaagttgggattttgataaacaacgttggtattacttatccacgcgccatgttcttccacgaggttgaccaacttacatggaccaaaatcctgagggttaatcttgaagccaccacttgggtcacacgatcactcatcggaccaatgcttcaccgccgccgtggagccatcgtcaatattagctccggcgctgccgttgttgtcccttctcatcccctctacgccatctacgctgccaccaaagcttatgtggatgcactatcaagatctctacatgtggaatataagcagtttggtattgatgtccagtgccaggttcccttatacgtgtcaacaaggatggtgtcagaagtggcagctatagacaaacctagcttatttgtaccgtcgcctgaagtctacgcaaaagcggcggtggcgcagatcggaattggatcacgttgctcgccgttttgggctcattctcttcagtggtttcttgttggacttgtaccggataaccttgttgatacttggcgtctctctatcggacttcgcagaagaagtttatcttaatgatcatattttcaagtttgtatttgctcctccacctttcgtggataaatatatggcccattgggcctgacagaaaaaacttatagaacacaatttgccctttaataatatttcaatgtgacataaaaaaa

SEQ ID NO: 741 - DNA, 957 bp, Arabidopsis thaliana
acagagaaacagagttttctgttttagcgagattggaaacttggttttgagcttaacattaaatggcggtcgtcatctccatccatcgtccttatgtaaccctcacaatctctaaaaatcgtaatcctcttaaacctcaccgacaattcaacgaatcctgcctgaggtttgatcatcttcctcggaacaccaaaaatcagctccgttgcttatctgcgaaatcgacgccatcgaaaccagaccctgcatcccctcaagatggggaagagctggagagtgtgggagtcaaagcagctttagcaatgctgagattctacaagagagagatatcgccggtgttacctagaagctgccgttacgttccgacttgcagtgaatactcaatggaagcttacaagaaatatggagttcttaaaggcactgttctcacaacttggcgtctctgtcgctgcaatcctcttggtggatctgggttcgatcctccaagatggtttggtgagagtgggatcaagctccgagaaggagacgaagaagaagaagataactatgacgacgaagatcaaagaaagatttgaatgaatttaagacaaaacagtagaagttgtacactaatactagagaaagcaatgggaaagctagcagatgtagaacaaagttttttgtaactacgagagaataagaatacatttgtttccaaaaagatttgatcttttctgtcttttggagcgatacatttaagtagacagatcttggaattgccatgggttgaattggatcgacttagggtcggtgttatcttcagagttatccgcagctgcacgatgttccgagtactttccattgaattggtaaacttccagatcaccccatggtgtagcagtgacttcttccgttacatcgaaccattttggagtaaaggcttggcctttctcttcgcgggttctcttttcagctctc

SEQ ID NO: 742 - protein, 182 aa, Brassica napus; identical to SEQ ID NO: 708

SEQ ID NO: 743 - protein, 182 aa, Brassica napus
MRKLKNHEKKVLKKVNFLEWKREGGHRETLITGRYHMGGRDDYKKYSGLCRMVQKLTNVLKQMDATDPFRIQMTDTLLEKLYNMGVIPTRKSLALTDRLSVSSFCRRRLSTVLVHLKYAEHLTEAVTYIEQGHIRVGPDTITDPAFLVTRNMEDFITWVDSSKIKRKVLQYNDKLDDYDMLA

SEQ ID NO: 744 - protein, 328 aa, Brassica napus; identical to SEQ ID NO: 709

SEQ ID NO: 745 - protein, 328 aa, Brassica napus
MTSDALNIPSELESALRLRTVQYFITKRPWLDLYGVHVRPVAPFGSTSSKPQFDPALIHRSLPDELLFEVFARMLPYDLGRAACVCRKWRYTVRNPVFWRNACLKAWQTAGVIENYRILQSKYDGSWRKMWLLRSRVRTDGIYVSRNTYIRAGIAEWKITNPVHIVCYFRYIRFYPSGRFLYKNSSQKLKDVAKYMIFKSSKADGLYRGTYTLSMTDDKIEAAVLYPGTRPTVLRIRLRLRGTAIGANNRMDLLSLVTSGVNDEEGGSTEEDILGVVENWRDDETHNPDIPAVSHKRGMTPFVFVPFEEVEQSVLNLPPEKMDYFVTG

SEQ ID NO: 746 - protein, 267 aa, Brassica napus
MQVVSPLSPATRFVGEESFAELYGKLNADFSSKLKVGFTNEEEEKNRDDNKSWWNQDDDDDEREEGEEDEEFSFTSLNADNSPITADEAFEDGQIRPVYPLFNRNLLFEPEERDLRSPLKKLFVESEEAATTEREEESEPMGPYCSWSGRTVVEEASPETCRKSSSTGFSKLWRFKDLVSRSNSDGKDAFVFLNHGDKKKQSSSKPAAKLSGGVKRTETKTTRSAHERLYMRNRAIREEGKRRSYLPYKHVGFFTNVNGLTRNVHPY

SEQ ID NO: 747 - protein, 270 aa, Brassica napus
MQVVSPLSPATRFVGEESFAELYGKLNADFSSKLKVGFTNEEEEKNRDDNKSWWNQDDDDDEREEGEEDEEFSFTSLNADNSPITADEAFEDGQIRPVYPLFNRNLLFEPEERDLRSPLKKLFVESEEAATTEREEESEPIGPYCSWSGRTVEEASPKTCRKSNSTGFSKLWRFRDLVLRSKSDGKDAFVFLSNGSSSQSSPSTTAAAAAKPSGVKRAEKAKMKTKSAHERLYMRNRAIREEGKRRSYLPYKHVGFFTNVNGLTRNVHPY

SEQ ID NO: 748 - protein, 44 aa, Arabidopsis thaliana; identical to SEQ ID NO: 61

SEQ ID NO: 749 - protein, 333 aa, Arabidopsis thaliana; identical to SEQ ID NO: 62

SEQ ID NO: 750 - protein, 419 aa, Arabidopsis thaliana; identical to SEQ ID NO: 65

SEQ ID NO: 751 - protein, 591 aa, Arabidopsis thaliana; identical to SEQ ID NO: 66

SEQ ID NO: 752 - protein, 234 aa, Arabidopsis thaliana
MDLEDWELVLPKNSFKDLDLDHDEDHHGAMVMDYFLCPSTKDPLPKTESPPRSKVVPKKILQVPIAWEAVLDQDNTKIPNNPDLEPDPHPDPDSKPTLSTDSVSSPRVSFKIMKDTEFADMKIDPPARITSPLPQIDDAASKPSDLEGGDDLRDKKEVVLEEEDEDGSGGERLNLWKAGLNGIGAICSFGVAAAAATVCVFFLGHNNIKICKNKNQMLRFQIYSDDNKVMFLIS

SEQ ID NO: 753 - protein, 216 aa, Arabidopsis thaliana; identical to SEQ ID NO: 74

SEQ ID NO: 754 - protein, 435 aa, Arabidopsis thaliana
MNNSTSVKRLVSSKAMKCFYFSKDKTQDDEAKTRKFGSATMARGGSGSEFNSDTSTATSITSSLHVLSETHSNNLKVFVLDDLKTATKNFSRSLMIGEGGFGGVFRGVIQNPQDSRKKIDIAVKQLSRRGLQGHKEWVTEVNVLGVVEHPNLVKLIGYCAEDDERGIQRLLVYEYVQNRSVQDHLSNRFIVTPLPWSTRLKIAQDTARGLAYLHQGMEFQIIFRDFKSSNILLDENWNAKLSDFGLARMGPSDGITHVSTAVVGTIGYAAPEYIQTGHLTAKSDVWSYGIFLYELITGRRPFDRNRPRNEQNILEWIRPHLSDIKKFKMIIDPRLEGNYYLKSALKLAAVANRCLMVKAKARPTMSQVSEMLERIVETSSDGAPSGLPLMKSLTPKDAFEASRRERVKRRFVELLIGENGCPNLPTWSHKLVTSI

SEQ ID NO: 755 - DNA, 1126 bp, Amborella trichopoda
tcggcacgaggctcgagagagtgacaagtacaagaagaagaaagggtagttttagagagagaatgccgatctctagaatcgcaatcggccgggccgaagaggccacccaccctgatgccttgaaggcagccttggctgagttcatctccaccctgatcttcgtctttgccggcgaaggctctggcatggctttcaacaagcttactgacaatgcatccaccacgcccgcggggctcgttgcggcgtcgttggcgcacgccttcggactatttgtcgctgtgtcggtcggagcgaatatttccggtggacatgtgaaccctgctgtgacatttggtgcctttgtgggcggcaacatcactctgctccgcggaatcctttactggatcgcccagctccttggcgctgtcgtcgcctgtggtctcctcaagttcgccaccggtggactgaccacctccgccttcggcttgtcgggtgtctccgtttggaacgcattcgtgtttgagatcgttatgaccttcggcctcgtctacactgtgtacgccaccgcaatcgacccaaagaagggcagccttggtataatcgcaccgatcgcgatcggtttcatcgtaggggctaacatcttggccggtggcgccttcaccggtgcctccatgaaccccgcggtctccttcggccccgccgtcgtgagctggtcatgggactcccactgggtctactgggctggaccactcatcggtggtggcctcgcagggcttatttacgagactgtattcatctctcacacccacgagcaactccccaccaccgactactaggtccccatcaatgcttttctttcttcttttatttctctgtgttttgtattgttgcagtggtgcttcttcttcttctccttctcttttgtttcacatgacctgtaattggagttgttaattatgcgtggtccctttgttttctggatcatcacgatttgcattcgcaatgttgggttcgttatttcccgtgatactgtgttcgaaatcgctcgttatttcctgtgatgctgagatcgaaatcgcaatcgattgaagctttttttaatgttttttttttyttgtgtgtttacattggtcatgagctttgtttg

SEQ ID NO: 756 - DNA, 1105 bp, Ricinus communis
actcagccacaggaccactctctagtctctgcctcgcaagtaaagaccacagccagcgtttgatccaaaaatgccgatcagaaacatcgccgttggccatccacatgaggcaactcagcccgacgccttaaaggcggcgttggctgagtttatctcaactcttatttttgtcttcgccggagaaggttccggtatggcctttaacaagctcaccaacaacggcgcagccactccttctggtctcgtggccgccgctatagctcacgcattcgctctttttgttgctgtctccgttggtgcaaacatctcaggtggacatgtcaatcctgctgtcacctttggtgctttcgtcggcggtaacatcactcttctacgtggtattctttactggatcgctcagcttctcggctccaccgtcgcttgcttgcttctcaagttcagtaccggcggtttgactacctcagctttcgctctatcctctggagttggtgtatggaacgcatttgttttcgaaatcgtgatgacctttggacttgtgtataccgtatatgcaactgccgttgatccaaagaagggaagtttgggaacaattgcaccgatcgctatcggttttatcgttggtgctaacattttggcgggaggagcattcgacggtgcatcaatgaaccccgcagtgtcgttcggaccagctttggtcagctggagctgggaaaatcactgggtgtactgggctgggcctttagttggcggtgggcttgctgggcttgtttatgagttcttcttcatccacagcacccatgagcagctccctaccactgactactaaaagataacggtggttgcgagtggatggcatgaaggtggtggcggtggccacgcggcttttctttctctggtgtatttatttgtatctcttgagggtattttatttatcctgttatttaatctgtaatcgtcgatctttggtttttctttttcatcattatcgatccaagggtgtgatttgtgtattctgatccggttgtattattctcattcaagacatcctatcgtccccgtattttcgcctcattttagtcttttttgtaaattttctattattttt

SEQ ID NO: 757 - DNA, 1236 bp, Gossypium hirsutum
ccatccaaagaattcggcacgagctcactcaacattcccatttccaatctccagctcccaaggtaaatatgccgatcagaaacatagcggttggccggcccgaagaggctactcaccccgatgctctcaaggctgctttggctgagttcatctcaaccttgatcttcgttttcgctggatcgggctcaggaatggcctttaacaagttgactgacaacggagcaaccaccccggctggtctcgtagccgccgctctagctcatggcttcggtcttttcgtcgctgtctccgttggcgccaacatctcaggtggccacgtcaaccctgccgtcaccttcggtgcttttgttggcgggaacatcactctcttgcgcggcattctttactggatcgcccaactcctaggctcaaccgtcgcttgcctgttgcttaagttcgctaccggcgacctggctgtacccgcttttgggttgtcatcaggtgtgggcgtgtctaacgcattggttttcgaaatcgtgatgaccttcggattggtgtacacagtgtacgccacagccgttgatcccaaaaagggaagcttgggaacaatcgcaccattggcaattggtttcatcgtgggggccaacattttggcaggaggtgccttcgatggagcctcaatgaacccagctgtttcatttggaccagccttggttagctggacatgggataaccactggatctactgggtcggaccccttatcggtggtgggctcgctggtctcatctacgagttcatcttcatcagcaacacccacgagcagctcccaaccaccgattattaagcctaatcagggtttaattgatttgtctgtcactttgaaaccggattttctccgatctcatttgagtttcctatctctttccttgttttttgtgtttaatttgtggcccgtcgatcttgtttacttttttttcattccccatcctctatcatgatcatcatgcatggcagatgttgtttacaattgcatgccctgaaaaaatagtatatgagtgactcactgtaagtcttttttcttatattattcaaaaccagcatcagggctgtaaatgtgacttttctctttacctcttccttgtttctatcatgtgcatttcctattcacttttaacttttcttaagtaagattgtacaggtggcatgtttcatttagacagaatatttaagataatgaaaaaaaaggagtttttttt

SEQ ID NO: 758 - DNA, 1105 bp, Gossypium hirsutum
ggcacgagctcactcaacattcccatttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaaccgtcgcttgcctgttgcttaagttcgctaccggcgacctggctgtaccagcttttggattgtcatcaggtgtgggcgtgtctaacgcattggttttcgaaatcgtgatgaccttcggattggtgtacacagtgtacgccacagccgttgatcccaaaaagggaagcttgggaacaatcgcaccattggcaattggtttcatcgtgggggccaacattttggcaggaggtgccttcgatggagcctcaatgaacccagctgtttcattcggaccagccttggttagctggacatgggacaaccactggatctactgggtcggaccccttatcggtggtgggctcgctggtctcatctacgagttcatcttcatcagcaacacccacgagcagctcccaaccaccgattattaagcctaatcagggtttaattgatttgtctgtcactttgaaaccggattttctccgatcacatttgagtctcctatctctttccttgtattttgtgtttaatttgtggccgtcgatcttgtttacttttttgttttttttcattcccatcctctatcatgatcatcatgaatggcagatgtttacaattgcatgccctgaaaaaatggtatatgagtgactcactgtaattcttttttcttatattattgaaaaccagcgtcagggctgtaaatgtgacttttctctttacctcttcc

SEQ ID NO: 759 - DNA, 1093 bp, Liriodendron tulipifera
atttgaagctgattccaagctcaaaaatctttaaaaaaaatcaaaaattccaaaaatgccagtcagcaggatcgcgatcggcactacacaggaggtgcgccacccaggcgccctgaaagccgcactggctgagttcgtctcaacactcatcttcgtctttgccggcgaaggctcgggcatggctttcaacaagctcacccatgacggatcgacgacaccatccggcctaattgcggcggcgttggcgcatgctttcgcacttttcgtagcggtgtcagtcggcgcaaacatctccggcggccacgtcaacccggcggtgacgttcggcgcattccttggcgggaacatttcactcttcagggggattttgtattggatcgcgcaattgcttggatccgtcattgcttgcctgcttcttaaattctgcactggaggattgacgacctcggccttctctctatcagcaggcgttggtgtctggaacgcattggtgttcgagatcgtgatgacgttcggccttgtctacaccgtctacgccacagctgtggacccaaagaagggtagcctggggaccattgcaccgatcgccattggtttcattgtgggtgcgaacatcctggccggtggtgcctttgatggtgcgtcgatgaacccggctgtctcctttggcccagctgtggttagctggacatggaccaaccactgggtctactgggtgggcccacttatcggtgctgcgatcgcagcccttctctatgacttgttcttcattggtgagaacccccatgaacagctccccaccactgattactaggtgggccatcgtctatcaaggaatgtggggtgcatgttcttttctcttagtcgcctttgcatgtgagcttctttcttcctctcttcgtttctatgcatttggtatgtctttctgtgtttggatgttgttttagtaggagctgggattcagagaygtttggctttgtttctgtgaatttgtactgtttttggcaattgtaacaaagtcagtgtacctctctctcaaaatgtgggtcggaagggtatttaaaaatctatttatgtattttgggagtaaaaa

SEQ ID NO: 760 - DNA, 1124 bp, Carica papaya
ggagaccagtacttgcagaaccatctcgacccttgcccataccaagatacctctctccctctcacgcatccctcgtttcatctgaatcagacgaacatgccgatcaggaacatcgcgatagggaggcccgaggaggcaacccacccagatgcactgaaagctgccttggccgagttcatatccatgcttatcttcgtcttcgcaggagaaggatcgggaatggcctttaacaagctcaccaacaacggagccgccactcccgccggcctcatcgccgccgcaatcgctcacgcctttgctctttttgtggccgtggccgttggcgccaacatctccggaggccacgtcaaccccgctgtcaccttcggcgccttcgtcggaggaaacatcagtctccttcgtggtatcctttactggatagctcagctccttggatccgtcgccgcctgcgcccttctcaagttcgccacaggcggcttgaccacctcagccttcgcactgtcgtcaggcgtcggagtgtggaacgcgttcgttttcgagatcgtgatgaccttcgggttggtgtacaccgtgtatgccacggccgttgatcccaagaagggaagtcttggaacaatcgcacccatagcgatcggtttcatcgtgggcgcaaacattttggccgggggggctttcgacggagcctccatgaacccagcagtctccttcggtcctgcagtggtgagctggagctgggacaaccactgggtgtactgggcaggacctctgatcggcggtgggctggctggcctcatctacgatttcttcttcatcagccacagccacgagcagcttccaaccgcagattactgagaggggaacttggtagtgggtttgcattgcatttgcatgggtgggaatgaaaagaaagaaaaaggaggcgtcgtttcgtattccctctgattttcttttttggtgtatttaatttgttttgagggtttcattaattttaaaatttgtgatattttaatgatgatgttatctaggaacgggggattgttgtatcgtgtggttttatggaagggagttgttgtttactctgttttagttgtatcattccccgttcgtgtattctcgttttcctc

SEQ ID NO: 761 - DNA, 1142 bp, Catharanthus roseus
tagtggatccaaagaattcggcacgaggcaaaaactgcactttctttcttcctagcctttccatttttctttttccgatcatccaaacatgcctttcaatcgaatcgctattgggaggacagaggaagccacccatcccgatgctttaaaggcggcattggctgagttcatatcaactttgatctttgtttttgcaggtcaaggttcagggatggcttttaccaagttgaccgatggtggcgcgagcactccggctggactgatctccgccgccatcgctcatgcgttcgcacttttcgtggcggtttctgtcggtgctaatatctccggtggacatgtaaaccctgctgttaccttcggtgccttcgtcggcggtaacattacactcctacgtggtatcctttactggatcgctcagttgcttggttcagttgttgcttgcttgcttctaaagttcaccactggtggcttggaaacatctgcctttgcattatcagccggagttggagtaggaaacgcactcgtattcgaaattgtgatgacatttggactagtctacaccgtgtacgccaccgcagtggatccaaagaagggtagtttgggtacaattgcaccaattgcaattggtttcatcgttggtgccaacatcttagccggtggtgcttttgacggagcctccatgaacccagccgtgtctttcggccccgccgttgtaagctggacatggactaaccaatggatatactgggttggtcctctcattggtggtggtattgccggagctatctatgaattggtctttattaaccacagccatgagcagttgccttccactgattattaagtttgaaatttatgtggatggatcggctctttttttaattttaatttaattttctttggtgtatgtatgtactttgtttaatttgttgaatattctcaagagggtgtttttaattttaatatttccaaggttggtttgttgatcaacttaatttggatcattacctcaaatgtgctatgggtgattaatcagttaattgtaatgggggatgggggtggggtcttcttttygggttgattaatatggtattgtgatcatycaacttttgcaacttttggaatctagtcctttattttat

SEQ ID NO: 762 - DNA, 1100 bp, Euphorbia esula
gcaccagtgaaacaacagataaaatctccgccaatctccgccgtcaaatcttgaccggaaaatcaatatgccgatcagaaacattgccatcggcgacactcgggaggcaactcacccggacgccttraaggcggctctggctgagttcatctccactctaattttcgtcttcgccggcgaaggttccggtatggctttcaataagctcaccgacaacggcgctacaactcccgccggacttgtcgccgctgctttggcacacgcttttgctctcttcgttgctgtctccgtcggagctaatatctccggcggtcatgttaatccggctgttactttcggcgctttcgttggcggtaacatttctctcctccgtggtatcctttactggatcgctcagcttgccggctccaccgtggcttgcttgctgctaaaattcagcaccggcggcttgaccacatctgctttcgctctatcttccggtgtaggagtatggaacgcctttgtttttgagatcgttatgactttcgggctagtgtacactgtttacgccactgcggttgacccgaaaaagggcagtttgggaacaattgcgccaattgcgattggttttattgtgggagcaaatattttggcaggaggggcatttgatggagcctcaatgaacccagcagtgtcctttgggcctgctttggttagctggagctggaccaatcwctgggtatactgggccgggcctttggttggakgtgggcttgctgggcttatttaygakaccattttcatcggacacggtgaccacgagcaactcccgacaactgactattgaagttacttagttccggtgggcgtgaatggatggttcggtggtggtgatggcggcccggctttttctttcattctctcatgtatttatttggatgtttttggagggtatttatttttcatcatgtttaatttgtaattgttgatctttttgcatcatcatcgtcatcgaaagggtttgatttgtgtatgattcgtttcaaagtccttcaccattttcttttttatttggatctcaataattttaattttcactttaaaaaaggctttatatgctc

SEQ ID NO: 763 - DNA, 1071 bp, Nicotiana tabacum
cattacggccggggatactagcctctaatcaaggatcaccatatacccaccaaaactccttcttattaaactctcttccatttctttgatcaacattcattcttgattttccgacgatgccgatcagccggatagcaatcggaagaccggaggaagccactcaccccgacgccttaaaggcggcgttggccgagtttatttccaccttaattttcgtatttgcaggttcaggttcaggtgtagcatttagcaagttgactggaggtggtgctaacacccctgccggtctcatcgccgccgcaattgctcatgcttttgggttgttcgtggcggtttccgtcggtgctaacatttccggcggacatgttaaccctgctgtcacctttggtgcctttgttggtggtaatatcacacttttacgtggaattttgtactggattgctcagttgcttggctctgttgttgcttgcttccttctcaagttcaccactggtggcttggagattggtacattcggcttgtctgatggagtgggtgtaggaaacgcattggtacttgaaatagtaatgacatttggcctagtctacaccgtgtacgctaccgcagtggatccaaagaagggcagtttgggaacaattgcaccaattgcaattggtttcattgttggagccaatattttggctggtggggcctttgatggggcgtctatgaacccagcagtttctttcgggccagcagttgtgagctggagctggaacaaccactgggtttactgggctgggcctttgattggtggtgggcttgctgggcttatttatgagttcttcttcattaaccagacccatgaacctttgccccaataagcaaagatgaaaattgcagaatgtaaatggtgaattttctctgtgtgattttggtcttctctgtttgatttcacaattgcccttgatttgggatgaagttggttgtattgtgtgatgctgttggggtgggtttgaaggggtatttatgtaattcatgtgttggttccacgtwtcagctcttttcattctattgcagtttcttttcctt

SEQ ID NO: 764 - protein, 250 aa, Amborella trichopoda
MPISRIAIGRAEEATHPDALKAALAEFISTLIFVFAGEGSGMAFNKLTDNASTTPAGLVAASLAHAFGLFVAVSVGANISGGHVNPAVTFGAFVGGNITLLRGILYWIAQLLGAVVACGLLKFATGGLTTSAFGLSGVSVWNAFVFEIVMTFGLVYTVYATAIDPKKGSLGIIAPIAIGFIVGANILAGGAFTGASMNPAVSFGPAVVSWSWDSHWVYWAGPLIGGGLAGLIYETVFISHTHEQLPTTDY

SEQ ID NO: 765 - protein, 251 aa, Ricinus communis
MPIRNIAVGHPHEATQPDALKAALAEFISTLIFVFAGEGSGMAFNKLTNNGAATPSGLVAAAIAHAFALFVAVSVGANISGGHVNPAVTFGAFVGGNITLLRGILYWIAQLLGSTVACLLLKFSTGGLTTSAFALSSGVGVWNAFVFEIVMTFGLVYTVYATAVDPKKGSLGTIAPIAIGFIVGANILAGGAFDGASMNPAVSFGPALVSWSWENHWVYWAGPLVGGGLAGLVYEFFFIHSTHEQLPTTDY

SEQ ID NO: 766 - protein, 251 aa, Gossypium hirsutum
MPIRNIAVGRPEEATHPDALKAALAEFISTLIFVFAGSGSGMAFNKLTDNGATTPAGLVAAALAHGFGLFVAVSVGANISGGHVNPAVTFGAFVGGNITLLRGILYWIAQLLGSTVACLLLKFATGDLAVPAFGLSSGVGVSNALVFEIVMTFGLVYTVYATAVDPKKGSLGTIAPLAIGFIVGANILAGGAFDGASMNPAVSFGPALVSWTWDNHWIYWVGPLIGGGLAGLIYEFIFISNTHEQLPTTDY

SEQ ID NO: 767 - protein, 251 aa, Gossypium hirsutum; identical to SEQ ID NO: 766

SEQ ID NO: 768 - protein, 252 aa, Liriodendron tulipifera
MPVSRIAIGTTQEVRHPGALKAALAEFVSTLIFVFAGEGSGMAFNKLTHDGSTTPSGLIAAALAHAFALFVAVSVGANISGGHVNPAVTFGAFLGGNISLFRGILYWIAQLLGSVIACLLLKFCTGGLTTSAFSLSAGVGVWNALVFEIVMTFGLVYTVYATAVDPKKGSLGTIAPIAIGFIVGANILAGGAFDGASMNPAVSFGPAVVSWTWTNHWVYWVGPLIGAAIAALLYDLFFIGENPHEQLPTTDY

SEQ ID NO: 769 - protein, 251 aa, Carica papaya
MPIRNIAIGRPEEATHPDALKAALAEFISMLIFVFAGEGSGMAFNKLTNNGAATPAGLIAAAIAHAFALFVAVAVGANISGGHVNPAVTFGAFVGGNISLLRGILYWIAQLLGSVAACALLKFATGGLTTSAFALSSGVGVWNAFVFEIVMTFGLVYTVYATAVDPKKGSLGTIAPIAIGFIVGANILAGGAFDGASMNPAVSFGPAVVSWSWDNHWVYWAGPLIGGGLAGLIYDFFFISHSHEQLPTADY

SEQ ID NO: 770 - protein, 251 aa, Catharanthus roseus
MPFNRIAIGRTEEATHPDALKAALAEFISTLIFVFAGQGSGMAFTKLTDGGASTPAGLISAAIAHAFALFVAVSVGANISGGHVNPAVTFGAFVGGNITLLRGILYWIAQLLGSVVACLLLKFTTGGLETSAFALSAGVGVGNALVFEIVMTFGLVYTVYATAVDPKKGSLGTIAPIAIGFIVGANILAGGAFDGASMNPAVSFGPAVVSWTWTNQWIYWVGPLIGGGIAGAIYELVFINHSHEQLPSTDY

SEQ ID NO: 771 - protein, 252 aa, Euphorbia esula
  misc_feature (216)..(216): Xaa can be any naturally occurring amino acid
  misc_feature (227)..(227): Xaa can be any naturally occurring amino acid
  misc_feature (235)..(235): Xaa can be any naturally occurring amino acid
MPIRNIAIGDTREATHPDALKAALAEFISTLIFVFAGEGSGMAFNKLTDNGATTPAGLVAAALAHAFALFVAVSVGANISGGHVNPAVTFGAFVGGNISLLRGILYWIAQLAGSTVACLLLKFSTGGLTTSAFALSSGVGVWNAFVFEIVMTFGLVYTVYATAVDPKKGSLGTIAPIAIGFIVGANILAGGAFDGASMNPAVSFGPALVSWSWTNXWVYWAGPLVGXGLAGLIYXTIFIGHGDHEQLPTTDY

SEQ ID NO: 772 - protein, 248 aa, Nicotiana tabacum
MPISRIAIGRPEEATHPDALKAALAEFISTLIFVFAGSGSGVAFSKLTGGGANTPAGLIAAAIAHAFGLFVAVSVGANISGGHVNPAVTFGAFVGGNITLLRGILYWIAQLLGSVVACFLLKFTTGGLEIGTFGLSDGVGVGNALVLEIVMTFGLVYTVYATAVDPKKGSLGTIAPIAIGFIVGANILAGGAFDGASMNPAVSFGPAVVSWSWNNHWVYWAGPLIGGGLAGLIYEFFFINQTHEPLPQ

SEQ ID NO: 773 - DNA, 1150 bp, Brassica napus
tcatagaaaagagagaagttttgtgtgttgtatctgttttgctctatttgatataaaaaaaaagaagatgcaagttgtttctccttcgtctccggcggcgaggttcgtcggaaaagaaagattcgccgagctttacgggaaattaaacgaagacttcagctccaaactcaaggtcggtgttacagagaaggaagaagaagaatctaatgatgaaggagaagaaggtgatgagttctcgttcgcgagtgtaaacggagagaactcacctataacggcggatgaagctttcgaaggcggtcagatccgaccggtttaccctttctttaaccggaatctcctcttcgaaccggaggctgaagaatctctccgttcgcctctcaagaaggtcttcgtggaaagagaggaagccaccaccaccaccaccaccgcgacggaagaatctgagccgatcggtccttactgctcgtggtctggtagaacggtggaggaagcttcgccgaagacttgtcggaaaagtaactcgacaggattctcgaagctttggaggtttagagatcttgtcctgagaagcaaaagcgacggtaaagacgcgtttgtgtttcttagtaacggttcttcgtcgcagtcgtctccttcaacggcggcggcggcggcgaaaccgagcggcgtgaagagagcggagaaggcgaagatgaaaacgaagtcggcacacgagaggctgtacatgaggaacagagcgataagggaagaagggaaacggagatcgtatcttccgtacaaacatgtcgggttcttcaccaatgtcaatggtcttacaaggaatgttcatccttactgatcatcaccttcttgttgctcagacaaaactttgatttcgtacatagttaaaaatctaaccatgtcttaataccattataataaccctttttctctaagcaaaaagttatttaaactgtttcgtatattcgtatcacattctagtttaccgacaatcgcttaatgaccaaaaacatccaagtacaaccaaatccattgattgatactttgatagtgacaacacatcacactaaacactccaaactctagatatgcgtctcccatgtatgcaaaactataccttatatgtttagaggcccattggggcttcgaa

SEQ ID NO: 774 - protein, 256 aa, Brassica napus
MQVVSPSSPAARFVGKERFAELYGKLNEDFSSKLKVGVTEKEEEESNDEGEEGDEFSFASVNGENSPITADEAFEGGQIRPVYPFFNRNLLFEPEAEESLRSPLKKVFVEREEATTTTTTATEESEPIGPYCSWSGRTVEEASPKTCRKSNSTGFSKLWRFRDLVLRSKSDGKDAFVFLSNGSSSQSSPSTAAAAAKPSGVKRAEKAKMKTKSAHERLYMRNRAIREEGKRRSYLPYKHVGFFTNVNGLTRNVHPY

SEQ ID NO: 775 - DNA, 2318 bp, Artificial sequence
  At6669 promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 776 - DNA, 277 bp, Artificial sequence
  NOS terminator
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 777 - DNA, 877 bp, Artificial sequence
  Cauliflower mosaic virus, 35S promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 778 - DNA, 1127 bp, Artificial sequence
  Napin promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 779 - DNA, 2970 bp, Arabidopsis thaliana
catctcggacttgatatcgtcaattagctcgaagcctcttagtgttttgctagccggagatcttctctctgtcccttcgtagtctagaagaacagacgcatcacatccctgaaagttgtgttaattcatgtacaaaaatgtcaagttgttatcttttaaaatgcataactatattagatatgcgcaaaacactcagatgcgtttatacacagaataaagtgcgcaagtccgtcttcaatattaagaaacttatatctatatactatcaatgttccaagtatggtctagatagacggaagaacaattctaatctctaatagagtaatagtgaaacccatttttagaacaatgtaaatcatatatgaatcaaaacattggctatatataattgaacgattaattgcaataccgtgacgccacaatcgtggaagataaggcggaggagggcgggaccaagggaagagtcactcttagtccattccctcactttcgtaacaacgattttctcaaaatctggacaaatcctatcataataattcaacgataataggttgtccaaagggaacaatgactttgtatcatcatcgtcatcgcctccgtatcctcccgctccaggtaagtcttttcggccagccgataccggccaagccacgagaactccgagtatgacaacgactgagaccacggccaacttcattattttgctttcttgatatctctctcaatttgattggctttgatgaatttgtttgatgagaggtgtgttgtgtagtaatttatatatacaattgggtttggaaactaatgtgatgcttttacgtgggaggcacaactttaagatttgaatattcgagtgacttgcctgcatgtcgtatataatgtttatgatatataatttttttttgatcaaatgatatatattaatagtataattttaaaaaacctttttacaagagaaaaaatgatataatgatctttacattactgaaatcagggttttgacttatttggattagattaattgtaaaatttatttgtcaacaacttccattgatttaattttgtttgttttttggtcggttatgtgagactattattattttattttgttgtctacaattaacatacgtatatatacactggatgatgacatcaaagtatgttttcgagtaatccgtaaagcaaaatgtgatatatcgaaattaacaaattttttgcacaatcattaataatgaatttgctcagatcctctaacaaaaatagcgatattacctctgcacattttttagcacggaaaaataggtccattagagacatgttgacaaaaaaaaaaaaacaattcaccataggctacgtttattgaaaattgatgcatctcaacaagttttcaaacgttcaaattttgagtttttttgaactatacaacaaattctcactagtcaaaaccttaaactttttcatatatttttctagtttttataatttatatttcttacaaataattgtagaaaactcaatttttgggtcatgaaaatcgccaacagtgtgaaaagaggccaaccaaaagcagttgattctctagaactcattgttaataactgaaatatatgtatgtaaactaatatttgctagaattataaaggagaaaagagtacaatcgaagtcggaaccaacgccggccggtcggaaaaatcacagaagaaaaatcgtatcaatcgctttttcaatcgtccatcttctttatctaccggataatacttcctaatacttaaactttaagaaaaaagattgtcagctagctatacgaagtgtggaagaatacattatcacatatgccgcaactaatataaacgatacccagttacctgaaatatatatacgaaatatatgtcgtatgtgccaatatcatagacactaagtctcgattaatcggtcgttttactctatcgttgactaatcgttaactcatcgggatccgaaaatgatcggttgtgaaccttattattggtttcaattatcgttattttgtatagagactattttttcttaaatcgttttataagagtcacaaatcacaactcgtcctaagttctctctctattcgactaacccaagcacgacattgaccactatgcctgggcctattgaccacactacaataaaatcgcacactacatgaaacttgggttgaacatctaattttctctaattaaattatttttactttgcttaaaagtttttgttcctgtcagttatacaatttaaaattgtttgttatctttagttcttcaatttgatttatgatgtggcataaaatccagaaagtgcatggttcccactcgacaacggctaaattcctcaacggctcctttttgactctagcatatttaggagccttaattattaaataatttaatcaccctttaattagtataacaatccaatgttaattttttcatgcattacacaattaaatgcttttaccagtataatgacatgtgttatacaatatctttcaaattcaattttgtccaaaattataagtagcttttttatttttctataacaatttatcacttttggccacataaggcttttctttctctgtattcttacacctcattctttattgccttgttttacagacacgttccccagtttaagggacaaaacagagccattttaggactcttaacatttataagtcctcttactaaatagataagcacaaatactgtttggttctgttttgcttcttcatcatcatcgtatctccaccgtttgtttgttgttgttctgtttctttaacaggaaaaaaaaacagagagaaaaatctgtctcttcactaacacaaatccattttctcttcttcttgtagagagacagagaaaacagagttgtcctctaacttctttcgatcgattcaaaaactctaatgattatttgattttatgttcgtttgttcgattc

SEQ ID NO: 780 - DNA, 2238 bp, Arabidopsis thaliana
gtttgatgagaggtgtgttgtgtagtaatttatatatacaattgggtttggaaactaatgtgatgcttttacgtgggaggcacaactttaagatttgaatattcgagtgacttgcctgcatgtcgtatataatgtttatgatatataatttttttttgatcaaatgatatatattaatagtataattttaaaaaacctttttacaagagaaaaaatgatataatgatctttacattactgaaatcagggttttgacttatttggattagattaattgtaaaatttatttgtcaacaacttccattgatttaattttgtttgttttttggtcggttatgtgagactattattattttattttgttgtctacaattaacatacgtatatatacactggatgatgacatcaaagtatgttttcgagtaatccgtaaagcaaaatgtgatatatcgaaattaacaaattttttgcacaatcattaataatgaatttgctcagatcctctaacaaaaatagcgatattacctctgcacattttttagcacggaaaaataggtccattagagacatgttgacaaaaaaaaaaaaacaattcaccataggctacgtttattgaaaattgatgcatctcaacaagttttcaaacgttcaaattttgagtttttttgaactatacaacaaattctcactagtcaaaaccttaaactttttcatatatttttctagtttttataatttatatttcttacaaataattgtagaaaactcaatttttgggtcatgaaaatcgccaacagtgtgaaaagaggccaaccaaaagcagttgattctctagaactcattgttaataactgaaatatatgtatgtaaactaatatttgctagaattataaaggagaaaagagtacaatcgaagtcggaaccaacgccggccggtcggaaaaatcacagaagaaaaatcgtatcaatcgctttttcaatcgtccatcttctttatctaccggataatacttcctaatacttaaactttaagaaaaaagattgtcagctagctatacgaagtgtggaagaatacattatcacatatgccgcaactaatataaacgatacccagttacctgaaatatatatacgaaatatatgtcgtatgtgccaatatcatagacactaagtctcgattaatcggtcgttttactctatcgttgactaatcgttaactcatcgggatccgaaaatgatcggttgtgaaccttattattggtttcaattatcgttattttgtatagagactattttttcttaaatcgttttataagagtcacaaatcacaactcgtcctaagttctctctctattcgactaacccaagcacgacattgaccactatgcctgggcctattgaccacactacaataaaatcgcacactacatgaaacttgggttgaacatctaattttctctaattaaattatttttactttgcttaaaagtttttgttcctgtcagttatacaatttaaaattgtttgttatctttagttcttcaatttgatttatgatgtggcataaaatccagaaagtgcatggttcccactcgacaacggctaaattcctcaacggctcctttttgactctagcatatttaggagccttaattattaaataatttaatcaccctttaattagtataacaatccaatgttaattttttcatgcattacacaattaaatgcttttaccagtataatgacatgtgttatacaatatctttcaaattcaattttgtccaaaattataagtagcttttttatttttctataacaatttatcacttttggccacataaggcttttctttctctgtattcttacacctcattctttattgccttgttttacagacacgttccccagtttaagggacaaaacagagccattttaggactcttaacatttataagtcctcttactaaatagataagcacaaatactgtttggttctgttttgcttcttcatcatcatcgtatctccaccgtttgtttgttgttgttctgtttctttaacaggaaaaaaaaacagagagaaaaatctgtctcttcactaacacaaatccattttctcttcttcttgtagagagacagagaaaacagagttgtcctctaacttctttcgatcgattcaaaaactctaatgattatttgattttatgttcgtttgttcgattcttagatcgtaaaaaa

SEQ ID NO: 781 - DNA, 3097 bp, Arabidopsis thaliana
gaaattggaaaagggtttaactttttttaagataaagacaggagaggactagagaaaagaagataaaagaaatgtggaagcgatttgttccctgcccgtctgccctgtttaagtaattagtgaacttctagatttcacaatctctaacaaaatagttttactcaattaaagttttgctgcgtaagcagaatgattaacaaagagaatggtatttgttttctgatttgatgagcgtgatatactgatactatagaatttgtcaactcgatcacgcgagaagtatgtagattgtcgataggtgtaattattagagttaacgaaaaattcgagtagccaaacttgagatgcaaacaaagcctacaaatgcaaatttatcaaaacctatgtctcgtctcgtccataaactagtcattctcttttcaagaattgtatacttgaatttgaaacaatgttattatgaacttgttgtaaatgttttcatatgtccatggtaattgaaaattgaggtggcattaaactgagtgcatgtttctctagaaacaaaacttaaagtgacacgaggtcggtgtaaatttgtttgtgtgttgtgaaattactgtcctcatttagtaatgtgacattgactgatgtcaggtcccatctctagttttgtccttcttcttttctatttttttaattaggagcctatcactctctcactacattcagaagtatttttgtttaattattctcactttttttttcgacttttgttcattatattttttttttcgatttttgttcattatattttttgttcattatatacctcgaggtgcgtccgataacctaaaatattaaattgcatgtacctcaaattacatgtaaaatatacgatcaaacatatgcatattgaaagaaatttgcagatcttttatcaaaaaaaattaagagattcatagaacacttaactataaattataggttttatacaaaaacacaaataaaactattattgtagagcaaattggtaaatttgaatactcaaaaaattacgccggatcaagttttcgaaagaagttaacggacagaacgacataattgtcgctaatggctggattttcctgttcataaagagatatctctaaagatttttaacgctctcaagtctcaacacatgaaaattgtgcatgtgcacgcaaaacattgacgctctcaacgtattgagaaatgagaatatacataggtgatggtacttaattatttgaataattgttttataactcccaacttcgttaggcaaatgttgagagtacactggtaacttaaaaattcgttgatatttacaaaagcaatgttacgaagttcgagctactgctagtacctagctaattgcaatatgtgtcgtattcaatgataaatagttgaggaaagttagtgttttatcatagtttagaaatgatgtcgtacataactctatttagagtgtttatgtaaacgaggattgattttgtagtttagtatgatctagccagaatattttgtccttttgtgatgaaattttgtggagcaacacgaaaatgttaacctaatggcagagatgtcatttatattttctatgtacttaaatgtataaactaccaaattaatataaactaattttctttaacataactcggatttgagaacaaaaattcaatctcgcaaaaataccattctttttaaaagttactgatcaatgggttgagatgaatgtaatacttgatcaatcgggctctattcttcgcagtgttaaaacaaaaataggtgaatttactgaaagtgaagaccagcctatggtctatctttcgtctcggttcaatatttttttaccattttcagatgacacgctctaaatacgtagtttgttcttttgtcggacaaaataaaaatattatagataaagaagatgttttgtattttgtacaatggtccgaagaaaagcccttttcacatatgtccaagggagaagaattgagggctacttttgtaaaatatcaatgaactgtcaatcagttctacagtatagatagaaatatataattaaaatattttcccatctttttcaaacttttgggtgcctttgtccacacctaaatgcccaactccttctctgcttttttctagcgacagaaaattattttatcgtagaaaaaatagcgagagatgaagagtaagaagacatccaagcttacaagtctttatcaataatgaagccaaatatatatatattttttaaacgatacgttcatttactttttctaaaacctacaatcattttctctctaatctaccaattaagtgatgagagtatgctagataaatatacacactaaaacgacaatactattcccatatgcttcttcagttctagttgcttgagtatttagaatcgaactatttacaagatatttaaaggtttcagaatttatagcggaagaaaggataacaactaaactgagaaaattcaaatatgagtcgtggacgtaaacgaactatgtatttaaaagaattgagagccagaaaccactaatttaaatatctcaattaaattgttagtaaaccctacacataaaaaagaaaaattcttttataagaacatctaaaattttaaaacctaaacgtaattttaataatatacctattacttccactgtaataggtattatagttgtgtgtttaatcgaaagaaaaagtttaatagttgtaacgaacgttttcgtttagtattatcccgaaaaggctatttagtccctccgacattaatttcgaaatattacattaaaaacaccaaacccggtatatgaaatgcagacaaaacaaacaatggatacaaaagagtaaaggtatgaaaactatagtccacctatctcaagtaatataaaaacaaaacaaggggaaaaaagaaacgacaaagtttatatcattttctctaattatataataatattctcaataaatcaattaatacgcaaaatatatatctgcacaaagtaaccttattatatctcccaaccgcacaaacaaaatttcagctcctccatatccatcaagaaagatcaagaatcaagaactaatc

SEQ ID NO: 782 - DNA, 3000 bp, Arabidopsis thaliana
ataaagacaggagaggactagagaaaagaagataaaagaaatgtggaagcgatttgttccctgcccgtctgccctgtttaagtaattagtgaacttctagatttcacaatctctaacaaaatagttttactcaattaaagttttgctgcgtaagcagaatgattaacaaagagaatggtatttgttttctgatttgatgagcgtgatatactgatactatagaatttgtcaactcgatcacgcgagaagtatgtagattgtcgataggtgtaattattagagttaacgaaaaattcgagtagccaaacttgagatgcaaacaaagcctacaaatgcaaatttatcaaaacctatgtctcgtctcgtccataaactagtcattctcttttcaagaattgtatacttgaatttgaaacaatgttattatgaacttgttgtaaatgttttcatatgtccatggtaattgaaaattgaggtggcattaaactgagtgcatgtttctctagaaacaaaacttaaagtgacacgaggtcggtgtaaatttgtttgtgtgttgtgaaattactgtcctcatttagtaatgtgacattgactgatgtcaggtcccatctctagttttgtccttcttcttttctatttttttaattaggagcctatcactctctcactacattcagaagtatttttgtttaattattctcactttttttttcgacttttgttcattatattttttttttcgatttttgttcattatattttttgttcattatatacctcgaggtgcgtccgataacctaaaatattaaattgcatgtacctcaaattacatgtaaaatatacgatcaaacatatgcatattgaaagaaatttgcagatcttttatcaaaaaaaattaagagattcatagaacacttaactataaattataggttttatacaaaaacacaaataaaactattattgtagagcaaattggtaaatttgaatactcaaaaaattacgccggatcaagttttcgaaagaagttaacggacagaacgacataattgtcgctaatggctggattttcctgttcataaagagatatctctaaagatttttaacgctctcaagtctcaacacatgaaaattgtgcatgtgcacgcaaaacattgacgctctcaacgtattgagaaatgagaatatacataggtgatggtacttaattatttgaataattgttttataactcccaacttcgttaggcaaatgttgagagtacactggtaacttaaaaattcgttgatatttacaaaagcaatgttacgaagttcgagctactgctagtacctagctaattgcaatatgtgtcgtattcaatgataaatagttgaggaaagttagtgttttatcatagtttagaaatgatgtcgtacataactctatttagagtgtttatgtaaacgaggattgattttgtagtttagtatgatctagccagaatattttgtccttttgtgatgaaattttgtggagcaacacgaaaatgttaacctaatggcagagatgtcatttatattttctatgtacttaaatgtataaactaccaaattaatataaactaattttctttaacataactcggatttgagaacaaaaattcaatctcgcaaaaataccattctttttaaaagttactgatcaatgggttgagatgaatgtaatacttgatcaatcgggctctattcttcgcagtgttaaaacaaaaataggtgaatttactgaaagtgaagaccagcctatggtctatctttcgtctcggttcaatatttttttaccattttcagatgacacgctctaaatacgtagtttgttcttttgtcggacaaaataaaaatattatagataaagaagatgttttgtattttgtacaatggtccgaagaaaagcccttttcacatatgtccaagggagaagaattgagggctacttttgtaaaatatcaatgaactgtcaatcagttctacagtatagatagaaatatataattaaaatattttcccatctttttcaaacttttgggtgcctttgtccacacctaaatgcccaactccttctctgcttttttctagcgacagaaaattattttatcgtagaaaaaatagcgagagatgaagagtaagaagacatccaagcttacaagtctttatcaataatgaagccaaatatatatatattttttaaacgatacgttcatttactttttctaaaacctacaatcattttctctctaatctaccaattaagtgatgagagtatgctagataaatatacacactaaaacgacaatactattcccatatgcttcttcagttctagttgcttgagtatttagaatcgaactatttacaagatatttaaaggtttcagaatttatagcggaagaaaggataacaactaaactgagaaaattcaaatatgagtcgtggacgtaaacgaactatgtatttaaaagaattgagagccagaaaccactaatttaaatatctcaattaaattgttagtaaaccctacacataaaaaagaaaaattcttttataagaacatctaaaattttaaaacctaaacgtaattttaataatatacctattacttccactgtaataggtattatagttgtgtgtttaatcgaaagaaaaagtttaatagttgtaacgaacgttttcgtttagtattatcccgaaaaggctatttagtccctccgacattaatttcgaaatattacattaaaaacaccaaacccggtatatgaaatgcagacaaaacaaacaatggatacaaaagagtaaaggtatgaaaactatagtccacctatctcaagtaatataaaaacaaaacaaggggaaaaaagaaacgacaaagtttatatcattttctctaattatataataatattctcaataaatcaattaatacgcaaaatatatatctgcacaaagtaaccttattatatctccc

SEQ ID NO: 783 - DNA, 2889 bp, Arabidopsis thaliana
cgaatcaatacgtaactttcaatctacaaatgaattataaagtcattcatttttggtattaaatacaagaaatatcgtccgagtcagccaatttaaaacgttaaagcccacctttaacttcgtccccaagccaaacttttaatttctcgattgtccgctacgctccacctcatcccaaacaaattacccgttttacccctttgttagataaagttaaaactatttgttagtttctttggtaaaacgaataatatcatattctccgtctatgttcgttattctgtttttaattttcggttcgttacagcttccacagcaagctcaaatggtaatatcattaatcatataagggcatttttgtcatttaacatgagtattatattaacctcatcttcgcttcatcttccttttcgcctatcttcctggatttttctctttcgctaaaaagaaccttcaagctctgtctctctcatcgctatataatataataaaatcaatcacacacaagactcgtgaaaggggacgatacgcgttttttattttgtacagactcaaattcaattcaattcaattttattcataagttctgggtttgaaatttgaacaattgaccgagatttgggaacgatgggtatggacttgagagttgttccggcggaggaatggttgaatcgagggatagattcgagtcacgacggtgaacatgacctaggcctaatggttacagattttctggaaacgggaggtggtagcggtggtgctggttcctggtgcagcagcgacagcgattctggattcccagatccttcttacctttccgataagattcaggtaccaccaccatcgcaccattttgatttatcctattagcttagattcatcggtgttttccactcgcgattagagaattttagagattatcatggatttgttagaatggtagcgtttgtggtttgttgtaatttgaaggaaggcatgttttagtacataggtttctaggaatggtgaagaacattttgttgaattaagagtatgtgtttgtatctgcagtatctcaagtactctatggctcaacacgaaaccgaggttctctcggtggttcgtacattgatgcttactattaaggagaaagatctacactctgtgaaatccggtacatgtaacgctagttgcatcaggttttatctcgctaagcttttgagactttctggatatgatgcagctgtatgttcagctagatggcaaggtggtggcaaagttcctggtggtatgttttcgcttctaagaaccgtcttatacaagtgtttctggacatagaattctgagagaatgatatgttttgtttgtttgcaggagataatgagtatatagatatcatattgagtgatactgaagttggtcaagatgatcgtttgattgttgatattgatttcagaagtcattttgagatcgctagagctgtggattcttaccaacggataatggaatcacttcctgtggtttatgtaggaactgttgcaagattaaaccagttccttcaagtaatggttgatgcagcgaaattctccttaaagcagaattcaatgccgttacctccatggagatctttgaactacctgcgatccaaatggcattcacctcacaaaaggcatctcggtcctatcgatcaacaaggtcctggaatgttctcaccgggattacatggacagtgtgctgagaatttaaagaggcttcagtttgctctccaggttgaacaagaggccgagagattcatgaagaagaagagcggttttagccgcaggaactaacccgagataatgagaattcaaggggctcgtgctccttaaagagattgtacagatgttttttggaggcatcaagaggccaaagaattttgctctgttgagtcgttttcgagtgtaatatttttgcggctgcgtctttttttctttttaatatggattcatttggggttacaataacagccaaggttaggctttatacaaagaagataatatacgaaaggtaccgcaatttttgccgctgttgtatgattcgacattgggagagattgttctaataagcatgtttctgtttggggttcttttccccgtgttattgagtgttgtaataacaatttaccaggaaaatatgattaacaaatcactgttatgatcaatgtttcttataattattcataccaatgtggtatacgtatgttatgacctctcatttcagatcactattgcacagttacgccagaaatgcaattagttaattgtggtcgatggactaattatcggactaatggtccgattagtccgtatctggttaagtcacataaacaagttaaatctgccttctaaattctaagatctacggtcatatccaatcatccacaattttgtattcatccagaaataaaaagccaatgatatatttctttctttctttcaataaatccatgatgaactaataataaatgtatttgatgcatatgacatgttatccaaacttatattccattttattcttaatttagtatatgatcttcccattaaattccattttattcttaattaggtataagatcttcccattaaattccattttattcttaattaagtataagatctacctctcttagtgatgtaaacttaataaaattgtgtaccatttgttgccgcccggttcttctatattagtttatattacatcaaatttgattacaatataaaaggcaacgttcatgcttatcatctacattaatttcactagatttttaaagaaaaattgtagagacatggagaatctacattagtagtataaatacacgcttattcttagcctagtcttactacacaaaacaaaacaaaacaaaacaaagca

SEQ ID NO: 784 - DNA, 831 bp, Arabidopsis thaliana
acattgggagagattgttctaataagcatgtttctgtttggggttcttttccccgtgttattgagtgttgtaataacaatttaccaggaaaatatgattaacaaatcactgttatgatcaatgtttcttataattattcataccaatgtggtatacgtatgttatgacctctcatttcagatcactattgcacagttacgccagaaatgcaattagttaattgtggtcgatggactaattatcggactaatggtccgattagtccgtatctggttaagtcacataaacaagttaaatctgccttctaaattctaagatctacggtcatatccaatcatccacaattttgtattcatccagaaataaaaagccaatgatatatttctttctttctttcaataaatccatgatgaactaataataaatgtatttgatgcatatgacatgttatccaaacttatattccattttattcttaatttagtatatgatcttcccattaaattccattttattcttaattaggtataagatcttcccattaaattccattttattcttaattaagtataagatctacctctcttagtgatgtaaacttaataaaattgtgtaccatttgttgccgcccggttcttctatattagtttatattacatcaaatttgattacaatataaaaggcaacgttcatgcttatcatctacattaatttcactagatttttaaagaaaaattgtagagacatggagaatctacattagtagtataaatacacgcttattcttagcctagtcttactacacaaaacaaaacaaaacaaaacaaagca

SEQ ID NO: 785 - DNA, 3000 bp, Arabidopsis thaliana
caagtcgggttccgactatcaaccttctggtcagcctttgcaaagaaggaagtgtaatagtttattcccacgaagtctgtcgaatctttcagttttgccttttgggctttggtaaatcttggcaaccgagatccaaccgcgtctttcatagactgaggatagtccccgaacgtggtaggatccaaatgcctaaagaaaaagaaaaacacaatgttgcaattatgtatatatataatcaagaataacattaaaatatatcaagagttgatgatttgtgtttttaaccagccaatgacgaaatcaagcacacggtttacagtcgcttgacctccttccacatcttcgggttcaaaccaagctggactatgagcgattccgattttaccacctttgcactttttcaaaaaaccgaaaaattaataagtaaaacttttaaaaaagttggtttatatgtcactgtggagaaacgaatgtgattaaatagggtattctgtttttaccttttcgcattttcggaaagcatcaacagcttcagcatgacccacgagtaaattgtgactgacaacataaggttcgaatcctgaccgtccatcttgacaaagctttccaaactctttgacgtaaggagaacaacgtcctggtgctttcttcccaacgtcgtagcccgaacggctaaagacccatggctcgttgaacgtaatccagtttttcactttgtccccatactcgtggaacgtgaagtttgcatactccacaaaatcaggcctatatattcacattttaaagtaagcaattatactttgatattacgtatagtagaaaaattactattgtacgaaacaacttaaaaacaataatcaaatgtgaagatatgacatgtacacttacacaatacgttcgcttaaaaagccaccgtattcatcttccaaatcggcgggagtatcccaatgaaaaaccgttactaatggtgttatgtctgaaaaacaataatttagtgagagttagttttttgcagttactatatgttactacgataaataaataaaaatgtagatataattgtggatatatagagttagagagagtctatgaccatttttaaggagctcatcaataagatcgtggtaaaattgaactccttctttgcttattcctttctccatcctcccatctgttatattattcagtaaccagctcttgttggaaaccaatagtaattctaaaattctcgtggcctatttttatttgttgaggaactcatgaatggtttaacttacgaggaaatattcttggccacgaaatagaaagtctaaaaccatcagtgttcagctttttcatcaactggatatcctcctgttgatttagataggcatacgaaacattagttataaaattaagtaattaacatgacttcgtagagcccatgaatctaacgattcactatgaaaattctaatcgataaaacttaataaaataaataactataaaaactgaaccttatgatgcactttatcctaagtgttatatagttaccaacttttacaagattaacttagttctttttttatttaactattcatcttgtgttgttccaaattattctttatacagttttgataaaatgttttcccgaaattaattatctggactacttcaatcatcttttagttgttcgaactacacgtgagaaaatgatactatcaatgatcaaacgtttaaaaagagaatctagaagctaataccttgtagcgatggtagaaatcgacggcctcgtcagcattgtgattcttaactctatctgcagtttaaatatagtacaaaatgttatttattatcaccagatatctggttcgctacacagttacttactataatactggtcgttaacaactctttataatacctcttggaatcaaattcataataacacacgagtgatgaatgcatgttttaaaaaaaccgacaactaataagtggacatatatatgcttcgtggtcgaaataaatagaaaagaaaagagacagacgtggaaatttcttggtgtagatgtcccacaggcttggacctctgcaaccttcatttactgcaccttccacctattttaaccatataaatacataaatcattttcattgttccatttcccaacatattcttagcttcacccaatgttttgtaagtgttttaatatcaccatttctatggatattttatctattttgtatacatatacatgtacctgaaaggctgcggttgcggtaccaaacataaagccctccggaaaacttgcacggctaagagtttcggtcttcgggcaaacaggtccttcttcagcccttgtcggagagccgacaagacttattagtaaaagtaaccccaagagaggaatcttcattgttgatttttttttataagctcacgagtgtgtttttggtcaaaaagttcaaaacaaagtggaagactatgttgatttgaaaggagaaatatcgttatatatttatagatatatacatgcatatatgcatgtacgtgacaccgatcaggtgatgaatttcaaagcccaaattgtatttggaggccgccaagtgtatttacactattacatgcagattgatcagttcttgaaggccaagtgtctttttgtcactctcactattgcatgcacattgtcaattttctgttatagtctcctcgttttaaggcgtgatattcgcatgtgtttgtaatattcgcatgtgttacacattatgtgtacgtcaaataaatctcacatctggatgttaagattgagtgtacgattctgtagaagcacaagtggatattgagaccaagtgtttgatatttgaagggtcataagcggattagaattttaataagtggaacaattatcatatagagtaacgtgtgatctttagatccacaagtttgggtttgagtcagtcgctatctaaataagtctccatgtctatataaaaacgcacttgcatgcatcagtcatca

SEQ ID NO: 786 - DNA, 880 bp, Arabidopsis thaliana
agctcacgagtgtgtttttggtcaaaaagttcaaaacaaagtggaagactatgttgatttgaaaggagaaatatcgttatatatttatagatatatacatgcatatatgcatgtacgtgacaccgatcaggtgatgaatttcaaagcccaaattgtatttggaggccgccaagtgtatttacactattacatgcagattgatcagttcttgaaggccaagtgtctttttgtcactctcactattgcatgcacattgtcaattttctgttatagtctcctcgttttaaggcgtgatattcgcatgtgtttgtaatattcgcatgtgttacacattatgtgtacgtcaaataaatctcacatctggatgttaagattgagtgtacgattctgtagaagcacaagtggatattgagaccaagtgtttgatatttgaagggtcataagcggattagaattttaataagtggaacaattatcatatagagtaacgtgtgatctttagatccacaagtttgggtttgagtcagtcgctatctaaataagtctccatgtctatataaaaacgcacttgcatgcatcagtcatcaccacaccaactctctcatctctttttgtcaacaaaaaaaaaacacagaagtacgtacgtagcctctctttcttaatggttcacttcattatttgcatttattatagcgttacaagaagttacaactacaaaaggaaaacttaattctcttcacccttttgtatatattatttttcagttatcttacaagtataatgaaaatgttataaatttatctgaaaaatgaaaaatgcatagccgtttttgttttttttaatgaaaagtttaacaaccggtaagatatgatcagataca

SEQ ID NO: 787 - DNA, 3000 bp, Arabidopsis thaliana
ctgtatgcaattttctataaggaatcgaagcaaagagagagactaacgatagggaaatcgagaggattgcgacgagtgagcttctcttcctcaggagccatagccaccacctgtaactgcttccttgtcttgcggcttagagcgaagcgttgaacggcgatgaaagagcacgagaagccatggttgattcgagagaaaggggaaaaaatagacggagcagctctgtttaacgacgatgaagatagtggcggagagagaagtggccacggcggcgaaggcgatgccgatatagaaagcggcgtcatagctccgcctcgtgttcttcgatggttcctatctgttccgtcaaacagttcatattattttctttatacttttaaaataaatcaaaattatcaattttttatttatgttattttataattcattccatttactttagacattcttataataaattaaattaaattaaatttagattaagaaatctgaaacccgaatcaaaatttttatattgaatatatgatacaaaattttgagttttaaatattttaggtaaattcgaatccaaatccaaaaacttgatccggcctgaatctcaagtcttaaaatattcaaaccactttttaatttccaaatctgaaatacccaacacgaataatctgacctgaacccaacacaaatagtgaatactcactcctgttaaatttgatgttatttttgaagtgtttgtttgcattttttttatttaagccgtctaaaatctttaaataatatatttgaaatttaacatgaaaaatgttattctaaaaaaatgaaaattaaattacaaaatagcaccatataataaaattaatttactacatagtccatttttacaggtttcatcatttgcttctactgtgaatttttaaatgaatacttaaagaaaaatatcataaagatatgtcgaattttgactaattaatagttcttgatgctatctgatgttttaaaacttcctcattggttatgtatcaattctcaaatctttgaccagtaccaatgacatgactagactcgccaacttatatatgtatagaagaacgaatatatggctaagtactaactactaagtactacgacgacaaagaaataaccattcacaagtctaaattatttttgctcaaaaatttaaaaatgatgaacgtttctctcaaactttcatttctggtttttattttggtcatcatgtctagtaagtattttttaatttatttaaatttaaaataaaagtcattaaaaatattttcaaaaatattttctatttggtgagttaaaacaaattcagaacatttaataagtaagtatactaagaaagtgatgaatgaatagatcttggatcagaagcaagggaactagccggtgttaacgagatattcgaaattgctgcgcgaagttcaaacaatgccggcaccgctagggccttgcagcaagccccaccttgcaagagggatgttgattgtagctttgaatgtcccaagggaggattctgcaatgatcgtcttggcacatgtgattgtttctaattgtattatttgatttctaatctacttttatcaataaagtttatccatcaattcttaagacttgatactaacgaggaaatgttttcaaaagatcggttgtgattacctttggtgaacctataatctttttcaacaaactatagaatattgactctttggattcccacacaacattaatctcctcacgtttatttgcatagtttctctcgctgaaaggcaaacctcgcagaactgactgaggaatgtatggtgaacccaagatctcgtttacaaaaccatgcagaattgactgagacttacaagttgatcccaataactcttccatcaatgtcaaccagtttactcaccaagattatacatacaaatggtctgaaatcactggcggtcattctcttttccaaatatgcggtccacacaactcataactcactatttagtttataagactgcaaagtttttatgtcgaaacttacaagatatggagtttggatgatttaggttgttcgtttcgtcgccgcagctatttatgttcgtttagttgccgcaactatctgcggtaaaacgcagcgttttgcggcgaaaatttttggacgccgactaattttagcgtcgataattaaaagctgcggttgcggcagcaaaacgaacaacaacctgcggtaggtttgtcgcagccgcagccgctgccgctgccgcaaccaccggcggtaacgaaacgaacatgcttcattaacttgatttattcttttattaaaaaaaattataactaactgcataaacttaaatatcaactatgtatataatgatacattatttatctatacggtaaaaaaaaagaataatattacgcactaaaattttgaagaagtgctactacatgtaaaactaaaatcagattataagaatctataatctaaggattgaaatcagattatgcacgctatatatagtttttatgataaattatttttgtacattatatattcataagactattccgcatattccacaatttcagccaagtaaatgttataatttacaaattattattattttcagtttttcgagttttgttaaatccaaaatcgttaacaaagatatttgaaattccacatgaaaatatgctatagttaattgctactaaatttacaaaatatcaagcaccatagaaatatctttttatactttgttacaaaagttatggtctgctagcttttctggtcaagatacacatgaccaattacagaaatattgttttgaattttgactaattaataagatctgactaatagtttttgatacattgtttacccttcatatttggtaagataacatctccaatcttgaccaggactaggcaacagcctgaacaattgatttgccacattataaatttatggctaaaagactacgaatacatagcaaactttca

SEQ ID NO: 788 - DNA, 1423 bp, Arabidopsis thaliana
gacttgatactaacgaggaaatgttttcaaaagatcggttgtgattacctttggtgaacctataatctttttcaacaaactatagaatattgactctttggattcccacacaacattaatctcctcacgtttatttgcatagtttctctcgctgaaaggcaaacctcgcagaactgactgaggaatgtatggtgaacccaagatctcgtttacaaaaccatgcagaattgactgagacttacaagttgatcccaataactcttccatcaatgtcaaccagtttactcaccaagattatacatacaaatggtctgaaatcactggcggtcattctcttttccaaatatgcggtccacacaactcataactcactatttagtttataagactgcaaagtttttatgtcgaaacttacaagatatggagtttggatgatttaggttgttcgtttcgtcgccgcagctatttatgttcgtttagttgccgcaactatctgcggtaaaacgcagcgttttgcggcgaaaatttttggacgccgactaattttagcgtcgataattaaaagctgcggttgcggcagcaaaacgaacaacaacctgcggtaggtttgtcgcagccgcagccgctgccgctgccgcaaccaccggcggtaacgaaacgaacatgcttcattaacttgatttattcttttattaaaaaaaattataactaactgcataaacttaaatatcaactatgtatataatgatacattatttatctatacggtaaaaaaaaagaataatattacgcactaaaattttgaagaagtgctactacatgtaaaactaaaatcagattataagaatctataatctaaggattgaaatcagattatgcacgctatatatagtttttatgataaattatttttgtacattatatattcataagactattccgcatattccacaatttcagccaagtaaatgttataatttacaaattattattattttcagtttttcgagttttgttaaatccaaaatcgttaacaaagatatttgaaattccacatgaaaatatgctatagttaattgctactaaatttacaaaatatcaagcaccatagaaatatctttttatactttgttacaaaagttatggtctgctagcttttctggtcaagatacacatgaccaattacagaaatattgttttgaattttgactaattaataagatctgactaatagtttttgatacattgtttacccttcatatttggtaagataacatctccaatcttgaccaggactaggcaacagcctgaacaattgatttgccacattataaatttatggctaaaagactacgaatacatagcaaactttcacgagactaaacattgaaaaatccaaagctcccattctaaaaatttgaaa

SEQ ID NO: 789 - DNA, 3000 bp, Arabidopsis thaliana
acctgcaacaatgatttattatgcatatgctcaggcttacagcaaaactaacctaagagacaactgcatgatgttctttcaagcacaaggattcattagcatttggcaggtaactcatccaaaataaataataggacaataccaggttgaaaaatggaagagaaaagatagccatcacaaaaattatgttgtccaccgtactttaccttcaatctttggtgctacgttacccaacgtcaatttgctgaacttcagggaagtaattcctggtggtctgtaatcttcaagcagaggttcaacagaatctcttattaccattgttgctgcctggaaattagtcaacacaacaacgaatattacactctttgatttccaagctgcattatggcaagtgttttccattccaacaaattggacctatcttaggtgtcaagaaacactcgatttgtgtagcagaaataaaaaaggcagtctacgagtccaatctagataagctaaatcttactgtttttcaataatttcggactttgtagtacaacttgacagtataacaactctactcttcctaggatatcttcagttaccattattcagggtaaatatgctaaagatttaatagccaacttccaaccgcatacacgggaaattaaaacacctaatactgcaacaaaagaaaattagaatctcacctctgcaatatatggccacatcttgctcagtagtttattcagccatttgacctgaaaaaaaagaaagaacaaaaggtttgcagtttaaaatttttgctatgtttctgagaaaccgagaagttaaactgtaatagactgttccaaaaccagagacattacgcaaattcaagtattgttaaactcaaggataatggaaccagaactagatttctccaatcagagtaatgaggcaaacaaatctataaactcaatgaatcacagaaatcatgtcaaccacggaccacccaaatatggaagatgaacactgagttagaaaagttaacaaagagaaatgatgacaagtagtacctgttcaaatgctggaaacgatatccattgagggaaattatcaccacaaattttcttcaaatcgtctctgctaagagagcctagtagtttcatatcaactgcctgtcagaaggtaagagtatacgtattctgttattgtaaggccaagaaaatcctctactcaaacttagaaagtaaagcaagccatgtcacttctcacacagaagcatagttaatcagtaaaatagtgaaccaccagcacgctaagtagagtcaacagatgaacactaaattggtacattgatgtcaatagttagaaattgcagagggattttgctaagccgatagtgataatttacgcgattcagctaattcccgagaccgagacaaactaatctatccaacacatatcacgacgaatttaaaatcccagatttaaaatcttaaaatatctccgatgaatcaatttcagaaccaaatcatggattttaatcgaataagtacattgatttaatcgaaccttggcgactcgcttggacgatcggtgagtcatcatacgactccagccagccattagagctacgccgaagataatcccgaacagaatcccagaaatcaaacccatttttcctgcaaccgaaacaaagattaccgaataagctcaaacaaccgatcaggaacttgaagaaaccctagaaatcgaaccacgaatgcaaacctttccgtcacaacaaaaccggtgttatcggcgagaagcgtcggcaacagtttatcctcacggggttggtcaagtggggagaatcagaacaaaattaagaacgcattgaagtatttttggtaggccagagagtgagataaatgggaagaggatgcgccaggcgacagattagaaacggttcttttcgaatcgcgattgtatttaattcattttccttcactattcatccctcatattttatattttctcaaattttgcccttcagtttctgattctactttagcatcaaatcatacatgattcagttaagtggaatgccatattgttgaataatttttttattttttttttaaaagaatcagctttatcttttattttattttattttgtcaataatccctattaaaaaaattcttcttagataatagaattgagaatttggtacgattgaaacaataaacgaatatgtggtcaaaattggaatgtgagcaataatacatggaccattttgagaaattaaagattctgcctcgttaacgaggcaacgaacgttttgatgattcgatgttccacgtgagtcgtgacttggtaaaaaacacatctctttaaagagttaaagacgtctttaccacaaaatcacatctcctacacgggcgacgttgaccgttgaccatcgatgaactagctataggaggcaattagtcgtttaaatttatatacgtcaacttttgtggttaaagataagctgtttcagttttattgaacttgaattctctaattcagtgttaattaatgattttacgttttacataatcgttgcacttattaccaaatttatatttcacatttaaatatggctagtttcgtttagcatgccccaatttgttatcactcgtaagaaatggaaagtggaaatcagaatatgttatgtcatttcagctttgtgattcggttcaaaagttatatatagaaatttagttgatttaatcaatttcatgaaaaagcataatttcaacagttttatctgataaaatttgcaagaatcacttgttggttggtcgacctccacatgtaacatcaagacaatggaatcggtgaagggacaaataacgtgtcttcctgatataatgacacagtttcttacaattacaaacctcaaattttcttacaaagattgtcactacttaaaatgtgcatcatataagattttcctaaagcacttccaataatttataatctggtttgacgaagcgtgcataatattag

SEQ ID NO: 790 - DNA, 1159 bp, Arabidopsis thaliana
gaagtatttttggtaggccagagagtgagataaatgggaagaggatgcgccaggcgacagattagaaacggttcttttcgaatcgcgattgtatttaattcattttccttcactattcatccctcatattttatattttctcaaattttgcccttcagtttctgattctactttagcatcaaatcatacatgattcagttaagtggaatgccatattgttgaataatttttttattttttttttaaaagaatcagctttatcttttattttattttattttgtcaataatccctattaaaaaaattcttcttagataatagaattgagaatttggtacgattgaaacaataaacgaatatgtggtcaaaattggaatgtgagcaataatacatggaccattttgagaaattaaagattctgcctcgttaacgaggcaacgaacgttttgatgattcgatgttccacgtgagtcgtgacttggtaaaaaacacatctctttaaagagttaaagacgtctttaccacaaaatcacatctcctacacgggcgacgttgaccgttgaccatcgatgaactagctataggaggcaattagtcgtttaaatttatatacgtcaacttttgtggttaaagataagctgtttcagttttattgaacttgaattctctaattcagtgttaattaatgattttacgttttacataatcgttgcacttattaccaaatttatatttcacatttaaatatggctagtttcgtttagcatgccccaatttgttatcactcgtaagaaatggaaagtggaaatcagaatatgttatgtcatttcagctttgtgattcggttcaaaagttatatatagaaatttagttgatttaatcaatttcatgaaaaagcataatttcaacagttttatctgataaaatttgcaagaatcacttgttggttggtcgacctccacatgtaacatcaagacaatggaatcggtgaagggacaaataacgtgtcttcctgatataatgacacagtttcttacaattacaaacctcaaattttcttacaaagattgtcactacttaaaatgtgcatcatataagattttcctaaagcacttccaataatttataatctggtttgacgaagcgtgcataatattag

SEQ ID NO: 791 - DNA, 2881 bp, Arabidopsis thaliana
cattgacttgagattcagttcatgagccattcaaaacgaccacgaccagcgtcaaaggctgtgaggaagatggcgcaaatgttgctacgaggatctatgagtcgtgttgctggtcgttgccgatctgagtttggtgatctaccaaattggtgtttatccactacaactgtttctccacttctccgatgatgtcgttagtattcttctccgattcaccttatcatctttgatctatcatgtatgtatgtgtatatttgtttttgaatatctattttttctatacttttacaaatcctctttttcaacttttgcttattttttcctaccaaaaaaaaaaacttttgcttatttttttctctttctaatctcttttataaaatctttgaatttaacggaatcataggttttttttttcttacataccattcgcttatgattccaactaatttgtatgtgctgctgtacaattaactttaactttaaatcagttttatttgctcaaattttcttgttattaattggtttttcattttggcaagtactcttccttttaccactgtatgagtagcttaaaaaggaacgaaacgaaaataaacaattatctgttcttgaatcttgtttttaattattggacagcatcatcaagaagatctgaaaaaattggggaaaattttgacggaagcagcgacggaggataagacggtgataataaccaccttaaacaaggcttggtctgagccgaactccacgtttgatttgtttctccacagttttcatgtcggaaaagggactaagccattactccgccaccttgtggtggcgtgcctcgacgaggaggcctattctcggtgctcagaggtccatccccatcgctgttatttcatgaaaacgccaggaattgatttcgctggcgataagatgttcatgacgccggactatctcaagatgatgtggcgtcgtatagagtttttgggtactttgttaaagctgagatataactttatcttcacggtacctatctttcactctatttgtacttcatctttaatatgtcgttgattttggtttgtcaacatttgcatattgttgattagtgtgacaaaaccagatgatatatataggctttgaatcaaattaggaggattcttgtgtaaccccgtgggttaatattaaaatcattagtagttgatgacttcatctaattatggttagggaagtagggttcttcaagtctctgtgacaatgattttaatattggttggtcactgttaacgttcattaaatggaaatatacatgcgtcttttatagaccctaggtagcaattagtcaaaatttggtgcaagtaaaaacgaatgaattggtagaagatgtagaatttgatgattcataatgttttattaacatatggttaatgtgtgtaggacatagatataatgtggtttcgagatcccatttcctcgtctatctaaagaagtcgatttccaaatcgcttgtgatcgttatagtggagatgataaagacatccacaacgctgtcaacggtggtttcgcttttgttaaagccaatcaacgaaccatcgatttctacaactattggtacatgtcgaggctgcgatatccggatcggcacgatcaagacgtgctggatcaaattaaaggtggtgggtaccctgcaaaaattggactcaaaatgaggtttctcgacacaaagtacttcggaggattttgtgagccaagtcgggacttggataaagtttgtacaatgcatgccaattgttgtgtaggattagagaataaaattaaggatttgagacaagtgattgtggactgggagaattatgtgtctgcagcgaagacaactgatggtcaaataatgacatggcgagatccggagaattgcatgaagcaatggtggtggagaaacaaaacaaaacaagtattgagtgaaaattcaaaagaaaactatttaaatattatgttgtttatcaaaacttatatcattctaaatttttgtttacctatgaataacataagaaagttttttttttgttttggtagtattttcgtaaataggtgaaattggtaaaaggttagagaaacaccatgacatctttaccatttggtgtggacgagatgagccaaaccctactagatgcatcattaaaaatacgtaagtcaacaccacctttctatatttctctatcatcaaaaatgttattgttatatacatgattaagatcctatgagattattttgctccatctttttgatctctatacggattgtcgttgtagattgtattcagtgctcgaatctccccttgcaagttttcaatttggaactaatgtcaaaccatctttttcagctgacaatgtttttatgtcaattgtagatatataacgatgttctattattgttgagtctgttcctgttcaaaacaataaagtttaggtactctatttttgaaatttattgttgtattttagcttaatattatttttaaaatacattaatatgcaatagaaaataatcttcttcttacaatccagagagaaatcaaatattgataacatgagattttaaataatatttaatattcattaacaaaaactataaatgatataaaaactatacctctataatagcttggcatgcagtatttcaaactagtcatctttgaccatttaactaaagatgataataaagctcaaatcacacaaaactccaggaaagaaatcaaccaaacaaaacacatatgtaagagagaaacaataaaaaaaacagtcaacattggtgtcttggaaatcacaagtgtcccataactcattcttctctctcacacgccattactaaaacccctaaaatcttcattcacttctct

SEQ ID NO: 792 - DNA, 942 bp, Arabidopsis thaliana
aattggtaaaaggttagagaaacaccatgacatctttaccatttggtgtggacgagatgagccaaaccctactagatgcatcattaaaaatacgtaagtcaacaccacctttctatatttctctatcatcaaaaatgttattgttatatacatgattaagatcctatgagattattttgctccatctttttgatctctatacggattgtcgttgtagattgtattcagtgctcgaatctccccttgcaagttttcaatttggaactaatgtcaaaccatctttttcagctgacaatgtttttatgtcaattgtagatatataacgatgttctattattgttgagtctgttcctgttcaaaacaataaagtttaggtactctatttttgaaatttattgttgtattttagcttaatattatttttaaaatacattaatatgcaatagaaaataatcttcttcttacaatccagagagaaatcaaatattgataacatgagattttaaataatatttaatattcattaacaaaaactataaatgatataaaaactatacctctataatagcttggcatgcagtatttcaaactagtcatctttgaccatttaactaaagatgataataaagctcaaatcacacaaaactccaggaaagaaatcaaccaaacaaaacacatatgtaagagagaaacaataaaaaaaacagtcaacattggtgtcttggaaatcacaagtgtcccataactcattcttctctctcacacgccattactaaaacccctaaaatcttcattcacttctctaacccaacaacacactatctctcatttctcttcaaaaaaaaaaaaaaaccttgaaactatgagtttccatgaccaaatccaataagtccacccggtaccaattcggatcataaaagtttcgttataaacagcaaaatc

SEQ ID NO: 793 - DNA, 2628 bp, Arabidopsis thaliana
acaaatactgtttggttctgttttgcttcttcatcatcatcgtatctccaccgtttgtttgttgttgttctgtttctttaacaggaaaaaaaaacagagagaaaaatctgtctcttcactaacacaaatccattttctcttcttcttgtagagagacagagaaaacagagttgtcctctaacttctttcgatcgattcaaaaactctaatgattatttgattttatgttcgtttgttcgattcttagatcgtaaaaaaatggtgtcttctcctcagagattcggtttaatcttaagagatcgtaaccaaaacgctggcgtttttcaaaagaatctgaaatctccggtgaaagaggttttgaaatctcatgtctccgatgagaatttagttgattcttggatcgaaactcacaataacaagaacaatcgtgttcttgaatctccgttagaatcgaagagaaacgacaatcttgtggcttcttctttggttcagatatgggaggcgaggctaaaccgatccaacggtggaaactcgccgagtagcagtcaatctacggcgagtagtagtagtcggagcgattcaggagttagtgttcaagattccggtctttcagaatcttcatcaatcgatggagattctgaaattgctgatcgaacggtggagattgaatctaggtcacatggtttggtttctgattccggagaaagtaaatggggacgagtcgctgacctaattcggaggcttagcaacgaagacaagaaacgaaccgctggagataatggcagcggcggtggcggtggactcgagattatcagaacgccgaggccttattgcacttcgtcgtcatcggagaaaagtaattttccggtggttagtttctctccgaagatacgaggacgacaagcgtttaccgattttcttatgcaaatggaacgtgatcgccaccgtgaattggattcgctttttgaacgcaacgcagtttctaggtttactcaacgtggtcgtctccagtcaatgctaaggttaaggaacctcaatcgctgtcttgtgattcaagatagaaaccggtctaacgcaaaaacaaccggattaaaccgaattgaatcaggctctgctgttctgcatttaagggagaaatttcatgcgaacgtagtaaactctgcggctgcaacagataagaggaagaatcatcaacgatccactgagatgaacaacaaatccgtagaagaaacagaaggaactactaccacaagcacgaggttaaaggatggtggtgttactctcgaagcttttttcgcagagcggttgagaccccgtaaccgcaagatagaggaagcaacgttatgtaaggaagaagaatctgtaagtggaacagttgattcacaaaagaattgccttcagctgcaagaaacaagagaagtagaagaaacttgcaacgatggcaagtctgaaaagaaagaagaagaaaatactagcccgagtgaatatttatctcgagaatcgcggttgagacagaatcaagacgagaacaatgtgggaaagtatatgcaagaaactcgagaaacagaaggtctagttcatgagagtaatgagatggaccagtgccttgatcaacaagaaacatcctatttgaatagatggggagaacaagaagagtatgcagatgagcagtcttattatggagaatataacgacgactggcttagtgaaatagctaggcctcggagttactgggaggaattgaggaagtcacggtacctggaagtaatgaacactaggtctgagaaagatgacatatgcagactccttgagcgaagaacggtgacagatttcctcgacagcgggttgcgagagaagatcgataatctcatgatgtcccgtgtacagacacactcggataagcactccaaaaaatgggaattgcaacaagaagaagaggaggaagtaaattttgaaattgatgaagaaatcaaagaagagccattaagaggaggtgaagagcaagatgatagagatgacttgagccaatcgtcgtcttcacatatatctgcatcgtctcctgcaggatcatggagttctcaagacactgatgttacttccactcctgccttggttgttcagaatcctcagtcacctgaaatggagctgataagcggtatgagatcacagatccaacagcttcagcaagaaatgtcagtactacgagattctgtcaaaacgtgtttagatgctaacgcgagcttgcaacacaaggctcaccaagaaaacccaatgaaacgaaaatgctgcgtctgcgacgaaacacaggtcgaggcggttttgtacaggtgtggacatatgtgcatgtgcctaaaatgtgccaacgaactacattggagtggagggaaatgtccgatttgcagagctcagattgttgacgttgttcgtgtcatctacgatacaagaaactgaaatcaaccgttttgaaaacgctgaagaattcactaacccattaaaccctcttttccttatcgagtttgcgttatttggcgttttgggtctgaatatcgtattatgctctctttatacagtttttaggttatgttaccaacactttgtccagttttatgaagtttttgatctccmaaa

SEQ ID NO: 794 - DNA, 958 bp, Arabidopsis thaliana
aaccgcacaaacaaaatttcagctcctccatatccatcaagaaagatcaagaatcaagaactaatcaatatcgatcgatccgttaaaaaaaaatggatatgattccccaattgatggaaggctcttcagcttacggaggtgtcacaaacctcaacatcatctcaaacaactcctcctccgtcaccggagccaccggaggtgaagcaacgcaaccactgtcttcctcctcctcaccatcggcgaactcaagccgttacgagaaccagaagaggagagactggaacacgttcggacagtacttaaggaaccatcggccaccgctttcgctttcccgatgcagtggagctcacgtgctcgagttcctccgttacttggaccagttcggtaagacaaaagtccacacgaacatttgtcacttctatggccatcctaatcctccggcaccgtgtccgtgtcctctccgacaagcttggggaagtcttgacgctcttatcggtcgtcttcgagctgcctttgaggaaaacggaggcaagcctgagacgaatccttttggagctcgtgccgttaggctttatctaagggaagttagagatatgcagagtaaagctagaggtgttagctacgagaagaagaagcgaaagcgtcctcttccttcgtcgtcgacttcttcttcctccgccgtagctagccaccagcaatttcaaatgctaccgggtactagttctactactcaattaaagtttgagaagtaagtaattatataattaagagaaatggagtattttatgtaatctgaaatgtgatttggtctctttcttatatgttgattttaattttaggttatgtggttcagttttagttactagtgtatgctggggggaggaaggtagggttttcaattttatttatatctaataaaagagaaattcacatgtattaatgtgtacatatttatata

SEQ ID NO: 795 - DNA, 1735 bp, Arabidopsis thaliana
atggccaaaacgattcggtctttcattctccctttcctcctcatagtcgccggcgtgatctttcaactctcagccgtgacttccgccattggtatcaactatggaacactagggaaccttcaacctccacaacaagtggttgacttcatcaagacaaagaccacttttgacagtgtcaagatctatgatgctaatcccgacatcctccgagccttcgcgggctctgaaatcaacatcaccatcatggtccctaacggtaacattcctgccatggtcaacgttgcaaatgctcgtcaatgggtcgctgccaatgtcttaccgtttcagcagcagatcaagttcaaatacgtttgtgtcggaaacgagattcttgctagtaacgacaataacttgatatcaaatcttgtaccagcgatgcaaagtcttaacgaagctttaaaagcttccaatctcacttatatcaaggtgacaactccacatgcatttaccataagctataaccgtaatacaccaagtgagagcagatttactaacgatcaaaaagatatttttacaaagatcttggaatttcatcgtcaggctaagtccccattcatgatcaacgcctacacttttttcacgatggacacgaacaatgtcaattacgcaatatttggtccatcaaatgcaataacggataccaatacacaacaaacctacaccaacatgtttgacgcagtcatggatgcaacatattctgctatgaaagctcttggctatggcgacgtagatatcgcggtaggggagaccggttggcccacggcttgtgacgcttcatggtgctcacctcaaaacgctgaaaactacaacctcaatatcatcaagcgtgcacaagttatagggacacctctaatgcccaaccgccacatcgatatcttcatatttgcattgttcaatgaagatggaaaacccggtccaacacgtgagagaaattgggggatatttaaaccggatttttcaccgatgtatgatgttggagttctaaaaggcggtggaagcccgcttccgtttccaccgataaacaacaatggaaaatggtgtgtgggaaaaccagaagcgacgttaatgcaactacaagcaaatattgattgggtatgcagccatggtattgattgtacaccaatctcacctggtggcatatgttttgacaacaacaacatgacgactcggtcctcgtttattatgaacgcttattaccaaagcaagggatgcgttgatgttgtctgtgattttagcggtactggcatcgttaccagtaccaacccaagcactagcacatgccctataccgataggggaaggtggcggcggcaatggcgcaaaaagcaaaagtgcaaattggtgtatggcgaaacaagaagcgacagagacacaactacaagctaatattgattgggtgtgtagccaaggtattgattgtaaaccaatatcacctggtggcatatgttttgataacaacaacatgaagactcgatccacgttcataatgaacgcttattacgagagcaaaggatactccaaagacgcttgtgacttccgtggtagtggcatcgtcactactaccaacccaagcactagcacatgcgtcgtaccagcatcagtaacgctctgaatttttaaaaagcaactacagaaactgaaaaaaatcaataaaacaagatccttttatttcattataagaacaatcatttttcgtt

SEQ ID NO: 796 - DNA, 1663 bp, Arabidopsis thaliana
accacaccaactctctcatctctttttgtcaacaaaaaaaaaacacagaagtacatacaatggcggccgcaacgatgtcttgggacgacgggaagcacatgaaggtgaagagggtgcagattacatatgaagatgttatcaactccatagaggctgaatacgacggagacactcataaccctcaccatcacggcactcctggcaagaaatctgacggcgtgagcttgagcccagacgagtacataacagatgttactggctactacaaaactacaggggctgaagatgctatagcagcattggcttttaagaccaacaaaactgaatatggtccttacggaaacaaaacaaggaaccaattctccattcatgctcctaaagataatcagatagctggtttccaaggaattagcagcaatgttctcaactctattgacgtccactttgctcccttaccttcctcttcgtcgtcatcgtccagtttgagtcaagccaacaaagttgatgctcaaggtgggaaaggaggaacatcatgggacgatggtgctcatgatcatgtaagacgagtgtacattggacaaggtgattctggtgtcacttatgtcaagttcgagtacgagaaggacgataagaaggaatcacgcgaacacggaaagaagacccttctaggagcagaagtgtttgaggttgatccagacgactacatcacatcagtggaagtgcaatctgacaggatatttgggcaagacacggaagttatcacctccttaatcttcaaaacatccaaagggaaattctcaccgccctttggactcgagggttcacagaaatatgaactcaaggacaagaatggtggtaaactcgttgggttccatgggcgagtaggcggcgaacttcttaatgctctgggagcttatttcgctccttcatccggtcgtggtaccccttcagccactcagccacctggatcagctcaaccaactggatcagctggtgctaagaaactagaagcaaaaggtggtaacgtgggaaatccatgggacgatggtcctcatgaaggtgtgaggaaagtgtatataggtcagggtgattctggtgtatcatacgtcaagtttgtctacgacaaggactctaaggaggtccccggaaatgatcatgggaaaagaacactacttgcacctgaagagttccttcttgaatatccaaacgaatatataacatcggtggagcttaactatgacaaaatatttggaactgaaggtgaaatcataacgatgcttaggttcacaacgaacaagcgaacctctccaccttttggacttgaaggtgccaaaagcgtcctactcaaagaagacggccacaagatagttggcttccatggcaaagcgggtgctgacataattcaccaagttggagtccatgtcaagcctatttccaagtgaagtttgtaatattttctcaagtcccggtctaataaaaatgagctatcaaaaaatctctgttctagaaattgtcattgtacttgtgtaaatggtaataaggtctttgacaatatgctacttgtgtgtttgtttgtgtttcaatgtctccttatactgtactggattggagtctgtaacactgtttcaacggtttctaagacgtatatataaaatcttggtta

SEQ ID NO: 797 - DNA, 389 bp, Arabidopsis thaliana
atagcaaactttttcacgagactaaacattgaaaaatccaaagctcccattctaaaaatttgaaaatgaagaacgcttctctcaagctcccactcttgatcttcattttggtcatcacatctaatcttggagcagaagcaagaaagctgaccggagttgctgacgtaattgttgaaggtgaagccgcaagtccacagtacggtatcatcgatgagaatgacactttgaacaaatccccatcttgcaagagggacatcgactgtacttttcagtgtcgcaggggaggattctgcaacctaatccttcaaaaatgtgaatgtttgtaataatatttacaatcgcattataatctaagtttatcaataaaagttatatatcaattcttcaaa

SEQ ID NO: 798 - DNA, 1598 bp, Arabidopsis thaliana
atggatattgtagcaatagtattgtctctgctctttatcttctttctcttcttctttttctacaccaccggaaaatcatgtcccggtggagccaagaacccaccgggtccttcaaagctatctctgcttcgtaacatccttcaaactgttgaaaaacctcaccgttcacttgccgatctctcaagaatttacggaagcgttatgagttttaagcttggctgtttgaccacagtggtcatatcttcaccggaaacagcaaaagaagtgctgaaaacacatgatcatgtcttgtcttatcgagtctccagtgacccggttcgagccgctggtcatcacgagctttccttgctctggattcctccgttggctcgttggaggtttctacgaaagataacgaggaaccaattattctcaacgcaacgtctagaagcaaccagtgctataaggacgaggaaggtgcaagaactcatgaacttcgttaacaaatgctgcgagagacgagaagctgtgaacatctctcgagcatcattcatcacatcactcaatataatctcgaacgctctgttttccacaaacctcgcaaactttgatgactcaaagacatttcacgatttccaaaacgtggtgattcggatgatggagatctccggaaaacccaacctcgctgatttcttcccttttcttgggtttcttgatctgcaaggagctagaaaagaagcgaggctattgatgcacaaactgtttagggtttttcaaggattcatcgatacaaagagatcatcaacttcgagaaataacaacgatatgttagattctcttttggatattgctcataagaaggagtcagaactcgatgacaataatatcaaacatctgcttctcgacttgtttctggcgggagtagacacgagttcgagtgcggtggaatgggctatggcggagttacttcgaaaccctaagatgatagtgaaagttcaagaagagataagacaagtgatagggctaaagggcaccgttcaagatcttgatatcgttaaactaccttatttacaagcagttgtgaaagagagtcttcgtttgcatccgcctgctcctttcctcgtccctcgaaaatcagagtctgatgatgtccaaattttcgagttcctcattcctaagaatactcaggttcttgtgaacgtgtgggcaatagggcgagatccgaatgtgtggaagaatccgacgcagttcgagccagagaggtttttgggaagaggaatagatgtgaaaggtaatcattttgagctgattccgttcggagctggacgacggatttgtccaggaatgccactcgcgtttaggataatgcatctagttcttgcgtctcttctctatggctttgactgggagtatcaaaacggcgtagttcctgaaaatgtggatatgaatgaggcctttggtgctaccttgcacaaagccgaaccattatgtatcgtgcctatcaagaaacgtgtttgacaattgacatcaatttcgatttctgtagttctcggccggtatagttcggtttctatctggttcggtcataacctttgaaattatgaaaaaatctaatttat

SEQ ID NO: 799 - DNA, 978 bp, Arabidopsis thaliana
aacccaacaacacactatctctcatttctcttcaaaaaaaaaaaaaaaccttgaaactatgagtttccatgaccaaatccaataagtccacccggtaccaattcggatcataaaagtttcgttataaacagcaaaatcatgctcaccaccacaatcttaatcttactcatagtgattcttatggtctctctccacctctactatcgttggtatctcctccgttctagccccttcaatcgcaccaccgctgcaagtacttttttcacggatccttcctccactcctggtggccttaacccctccatcatcaaatctcttccaattttcacgttctccgccgtaaccgcccttttcgcaatggaatgctccgtttgcctctcggagttcaaagataatgaatcgggtcgggttatgcccaattgcaagcatacatttcacgttgactgcattgatatgtggtttcattctcattcctcttgtcctctctgtcgatctctaatcgaacctttcgccggtggagtaaaatcgacgatggatgaagtcgcgatttcgatttctgacccggtttacggtgacacgaaccatcacgaaggaactgagactaccggtgattcggttcctgaagattcacagagaaaaccggcagcgattgaaatctcacagaggaatctcggagaaatagagaatgatttgtctcggagtcactcgtttagatcaccgaccgatgagccggatgatatctttcactcggaatttgagtcgagatctggagaagtgcttcttcttcttcttcttctatcagaattccgcatattttgtttccgacggtcagtagcatgcaagtgactgagttagatatcgaattgggaggagaagagactcgttgacttattcaatgttacatcacgtggattgtattaatggttgtaatttatctctttcttttttcagtttagagtttaatatgcaacatgttaa

SEQ ID NO: 800 - protein, 730 aa, Arabidopsis thaliana
MVSSPQRFGLILRDRNQNAGVFQKNLKSPVKEVLKSHVSDENLVDSWIETHNNKNNRVLESPLESKRNDNLVASSLVQIWEARLNRSNGGNSPSSSQSTASSSSRSDSGVSVQDSGLSESSSIDGDSEIADRTVEIESRSHGLVSDSGESKWGRVADLIRRLSNEDKKRTAGDNGSGGGGGLEIIRTPRPYCTSSSSEKSNFPVVSFSPKIRGRQAFTDFLMQMERDRHRELDSLFERNAVSRFTQRGRLQSMLRLRNLNRCLVIQDRNRSNAKTTGLNRIESGSAVLHLREKFHANVVNSAAATDKRKNHQRSTEMNNKSVEETEGTTTTSTRLKDGGVTLEAFFAERLRPRNRKIEEATLCKEEESVSGTVDSQKNCLQLQETREVEETCNDGKSEKKEEENTSPSEYLSRESRLRQNQDENNVGKYMQETRETEGLVHESNEMDQCLDQQETSYLNRWGEQEEYADEQSYYGEYNDDWLSEIARPRSYWEELRKSRYLEVMNTRSEKDDICRLLERRTVTDFLDSGLREKIDNLMMSRVQTHSDKHSKKWELQQEEEEEVNFEIDEEIKEEPLRGGEEQDDRDDLSQSSSSHISASSPAGSWSSQDTDVTSTPALVVQNPQSPEMELISGMRSQIQQLQQEMSVLRDSVKTCLDANASLQHKAHQENPMKRKCCVCDETQVEAVLYRCGHMCMCLKCANELHWSGGKCPICRAQIVDVVRVIYDTRN

SEQ ID NO: 801 - protein, 219 aa, Arabidopsis thaliana
MDMIPQLMEGSSAYGGVTNLNIISNNSSSVTGATGGEATQPLSSSSSPSANSSRYENQKRRDWNTFGQYLRNHRPPLSLSRCSGAHVLEFLRYLDQFGKTKVHTNICHFYGHPNPPAPCPCPLRQAWGSLDALIGRLRAAFEENGGKPETNPFGARAVRLYLREVRDMQSKARGVSYEKKKRKRPLPSSSTSSSSAVASHQQFQMLPGTSSTTQLKFEK

SEQ ID NO: 802 - protein, 549 aa, Arabidopsis thaliana
MAKTIRSFILPFLLIVAGVIFQLSAVTSAIGINYGTLGNLQPPQQVVDFIKTKTTFDSVKIYDANPDILRAFAGSEINITIMVPNGNIPAMVNVANARQWVAANVLPFQQQIKFKYVCVGNEILASNDNNLISNLVPAMQSLNEALKASNLTYIKVTTPHAFTISYNRNTPSESRFTNDQKDIFTKILEFHRQAKSPFMINAYTFFTMDTNNVNYAIFGPSNAITDTNTQQTYTNMFDAVMDATYSAMKALGYGDVDIAVGETGWPTACDASWCSPQNAENYNLNIIKRAQVIGTPLMPNRHIDIFIFALFNEDGKPGPTRERNWGIFKPDFSPMYDVGVLKGGGSPLPFPPINNNGKWCVGKPEATLMQLQANIDWVCSHGIDCTPISPGGICFDNNNMTTRSSFIMNAYYQSKGCVDVVCDFSGTGIVTSTNPSTSTCPIPIGEGGGGNGAKSKSANWCMAKQEATETQLQANIDWVCSQGIDCKPISPGGICFDNNNMKTRSTFIMNAYYESKGYSKDACDFRGSGIVTTTNPSTSTCVVPASVTL

SEQ ID NO: 803 - protein, 455 aa, Arabidopsis thaliana
MSWDDGKHMKVKRVQITYEDVINSIEAEYDGDTHNPHHHGTPGKKSDGVSLSPDEYITDVTGYYKTTGAEDAIAALAFKTNKTEYGPYGNKTRNQFSIHAPKDNQIAGFQGISSNVLNSIDVHFAPLPSSSSSSSSLSQANKVDAQGGKGGTSWDDGAHDHVRRVYIGQGDSGVTYVKFEYEKDDKKESREHGKKTLLGAEVFEVDPDDYITSVEVQSDRIFGQDTEVITSLIFKTSKGKFSPPFGLEGSQKYELKDKNGGKLVGFHGRVGGELLNALGAYFAPSSGRGTPSATQPPGSAQPTGSAGAKKLEAKGGNVGNPWDDGPHEGVRKVYIGQGDSGVSYVKFVYDKDSKEVPGNDHGKRTLLAPEEFLLEYPNEYITSVELNYDKIFGTEGEIITMLRFTTNKRTSPPFGLEGAKSVLLKEDGHKIVGFHGKAGADIIHQVGVHVKPISK

SEQ ID NO: 804 - protein, 86 aa, Arabidopsis thaliana
MKNASLKLPLLIFILVITSNLGAEARKLTGVADVIVEGEAASPQYGIIDENDTLNKSPSCKRDIDCTFQCRRGGFCNLILQKCECL

SEQ ID NO: 805 - protein, 498 aa, Arabidopsis thaliana
MDIVAIVLSLLFIFFLFFFFYTTGKSCPGGAKNPPGPSKLSLLRNILQTVEKPHRSLADLSRIYGSVMSFKLGCLTTVVISSPETAKEVLKTHDHVLSYRVSSDPVRAAGHHELSLLWIPPLARWRFLRKITRNQLFSTQRLEATSAIRTRKVQELMNFVNKCCERREAVNISRASFITSLNIISNALFSTNLANFDDSKTFHDFQNVVIRMMEISGKPNLADFFPFLGFLDLQGARKEARLLMHKLFRVFQGFIDTKRSSTSRNNNDMLDSLLDIAHKKESELDDNNIKHLLLDLFLAGVDTSSSAVEWAMAELLRNPKMIVKVQEEIRQVIGLKGTVQDLDIVKLPYLQAVVKESLRLHPPAPFLVPRKSESDDVQIFEFLIPKNTQVLVNVWAIGRDPNVWKNPTQFEPERFLGRGIDVKGNHFELIPFGAGRRICPGMPLAFRIMHLVLASLLYGFDWEYQNGVVPENVDMNEAFGATLHKAEPLCIVPIKKRV

SEQ ID NO: 806 - protein, 235 aa, Arabidopsis thaliana
MLTTTILILLIVILMVSLHLYYRWYLLRSSPFNRTTAASTFFTDPSSTPGGLNPSIIKSLPIFTFSAVTALFAMECSVCLSEFKDNESGRVMPNCKHTFHVDCIDMWFHSHSSCPLCRSLIEPFAGGVKSTMDEVAISISDPVYGDTNHHEGTETTGDSVPEDSQRKPAAIEISQRNLGEIENDLSRSHSFRSPTDEPDDIFHSEFESRSGEVLLLLLLLSEFRIFCFRRSVACK

SEQ ID NO: 807 - DNA, 1243 bp, Arabidopsis thaliana
cctctgtcttgtcttttggttagtataagtattgataaattcctttgaccagcaagatatcatcactaaaagattttacattaccaagccatctccaatatcatcaggtcaagtgatgttgtttctaaccgcggctgtctgtttaatatgcttttacgtctacaagtccgtgaaaccgccgccgccaattccattgccggagaatgtttctgagatatctccaagaatcaagctcaacgatggcagatatttagcttacaaagaattagggtttcctaaagacaaagccaaaaataagattatcattctccatggattcgggagttccaagttagtggatttaaaaatcacacaggaaatgatcgacgaattcgagatatacttcttgttgttcgatagagctggttatggagaaagcgatcctcatccatcacgaacactaaaaacggatacatatgacatcgaagaacttgctgacaaattgcaaatcggtccaaagttccatgtcctaggaatgtcactcggggcttatccagtttacggctgtctcaagtacattcctcatagactaagtggagcaacgttggtggttccgatactgaatttttggtggagttgtctgcctctaaacttgtcgatttcagcgttcaagaaattgccaattcaaaatcagtggacacttggagtcgcacactactttccatggttattatattggtggatgactcagaaatggttttccccatttagtcagaatcctagagaaactatgaccgagcgcgatatagagctcgcggataagcatacaaaacacgcatatattaaggaatccgcactacgacaaggtgaatatgtgagcatgcaacgagacatcattgcgggttacgagaattgggagtttgatccaaccgaactgagcaatccattttcagatgataacaaagggtcagttcacatttggtgtgcactcgaagacaaacaaatttcgcatgaggttttactctacttatgtgataagcttccatggataaagcttcatgaagtccctgatgctggacatcttattatccatgagaagcagcattttgaagacattattaaagccgcttgtagttgaaggttaaaaaaaaaaacttaattcaatagtttgtgtgtggactggatttgaaagttgatattatataaaatatatgttcaatgtcacatatatatattttgttacaattaaattcattttactact

SEQ ID NO: 808 - DNA, 1220 bp, Arabidopsis thaliana
ctctctaaacgcataatcttacaataaaatggtgaaactcgcgacggcgcgtgagattagaacgtacggccctcggcttgggaggagcagagccgagtacatcaacgcaggtctatacttgtttgcaaccgtggtgctcatcggcggtttcacagcgacaggattctcatgggaaccaagatccggcctcgtccttattctcttagctctcgttcttataaccgccgtgaatgttcatgatcttgtggctcatctagctggaatcgattaccggttaaggttaatggagtatgatttgcaactggggctagtggaatttgcagtccctctggttcagatagcgggttcggtagtgtttttcttgggaatctttttcgtcttccatcaggctgagacaaaacgtggatacagtggaagagagcatcatgcattaaacttgctgatagcgggtccgttactttggttgataggatcgattcacaactcatgccaaatctacgagagagcggatagtcatgttcaaattctacagcagtgtgtttacattcctttcttggttggatcccttctattcttggtttccgcagttctcaatagcctcgacatatccgggtcatctcgtagtggattgaagcttcttggggaaagatggatttggcttgggatttccggggctatatgtttgtttgtgggaggattgctgaacgttgttaaggtttttaacttcgtccagatctctgggctccgcctcgagaaactacggggtggagctcaagaccgacttcttgaagggagagaaggatatctccctcttgttgctgaagaagaaagaataaggaaaatggaagctgatcacgaagcttctagtagagccaaaccccgggcacacacaacctccaaagccggagagggagctacagagaccgtggtggtatcatctccgacaccatacaaggatgttctcgttggacagatctgaggaagattagtcatgtttaaatgttcttttgtactccatatttgtttttagctgcggagaccacatattttgccgttcaacatatgttatgtgattcgtttcctttttggtcagtctttatgaatattgaaataggttacaatacatcaagactttagaagaagatttgtacactagaagaatattgatcttctttatgaataatgaaatagggtctttatacctatttctatttgacgat

SEQ ID NO: 809 - protein, 250 aa, Musa acuminata
MPFSQIAIGRPEEATHPSALKAALAEFICTLIFVFAGQGSGMAYNKLTSDGAATPTGLIAAALAHGFALFVAVSVGANISGGHVNPAVTFGAFVGGNITLLRGILYWIAQLLGSTVACLLLRFSTGGLETGTFGLSGVSAWEALVLEIVMTFGLVYTVYATAVDPKKGSLGTIAPIAIGFIVGANILVGGPFSGASMNPAVSFGPALVSWSWTHQWIYWLGPLIGGGLAGIVYEFFFISHSHEQLPTTDY

SEQ ID NO: 810 - protein, 250 aa, Brachypodium distachyon
MPISRVAVGSHHEVYQAGALKAAVAEFISTLIFVFAGQGSGMAFNKLNAGGAATPAGLISAAIAHAFALFVAVSVGANISGGHVNPAVTFGAFLGGNITLFRGLLYWVAQLLGSTAACFLLRFSTGGLPTGTFGLTGVSVWEALVLEIVMTFGLVYTVYATAVDPKKGSIGTIAPLAIGFIVGANILVGGAFDGASMNPAVSFGPALVSWEWGYQWVYWVGPLIGGGLAGVIYEVLFISHTHEQLPTTDY

SEQ ID NO: 811 - protein, 252 aa, Brachypodium distachyon
MPVSRIAIGSPGELSHPDTFKAAVAEFISMLIFVFAGSGSGMAFGKLTDGGATTPSGLIAAALAHAFALFVAVSVGANISGGHVNPAVTFGAFIGGNISLLKAIVYWVAQLLGSTAACLLLQISTGGASVGAFSLSAGVGVWNAVVFEIVMTFGLVYTVYATAVDPKRGDLGVIAPIAIGFIVGANILAGGAFDGASMNPAVSFGPAVVSGVWENHWVYWLGPFAGAAIAALVYDIVFIGQRPHDQLPSAEY

SEQ ID NO: 812 - protein, 251 aa, Ricinus communis; identical to SEQ ID NO: 765

SEQ ID NO: 813 - protein, 251 aa, Citrus sinensis
MPIRNIAVGHPREATHPDALRAALAEFISTLIFVFAGEGSGMAFNKLTHNGANTPSGLVAASVAHAFALFVAVAVGANISGGHVNPAVTFGAFVGGNISLLRGILYWIAQLLGSTVACLLLKFVTNGQTTSAFALSSGVGAWNAVVFEIVMTFGLVYTVYATALDPKKGSLGTIAPIAIGFIVGANILAGGAFDGASMNPAVSFGPALVSWSWDNHWVYWVGPLIGGGLAGIVYEFFFINQSHEQLPTTEY

SEQ ID NO: 814 - protein, 252 aa, Citrus sinensis
MPIYRIAIGTPGEASHPDALKAALAEFFSMLIFVFAGQGSGMAFSKLTDGGASTPAGLISASLAHAFALFVAVSVGANISGGHVNPAVTFGAFVGGHITLLRSILYWIAQLLGSVVACLLLKFSTGGLETSAFALSSGVSSWNAVVFEIVMTFGLVYTVYATAVDPKKGNLGTIAPIAIGFIVGANILAGGAFDGASMNPAVSFGPAVVSWTWTNHWVYWLGPFIGAAIAAIVYDHIFIDDNAHQPLPANDF

SEQ ID NO: 815 - protein, 252 aa, Citrus sinensis
MPIYRIAIGTPGEASHPDALKAALAEFFSMIIFVFAGQGSGMAFSKLTDGGASTPAGLISASLAHAFALFVAVSVGANISGGHVNPAVTFGAFVGGHITLLRSILYWIAQLLGSVVACLLLKFSTGGLETSAFALSSGVSSWNAVVFEIVMTFGLVYTVYATAVDPKKGNLGTIAPIAIGFIVGANILAGGAFDGASMNPAVSFGPAVVSWTWTNHWVYWLGPFIGAAIAAIVYDHIFIDDNAHQPLPANDF

SEQ ID NO: 816 - protein, 251 aa, Citrus sinensis; identical to SEQ ID NO: 813

SEQ ID NO: 817 - protein, 252 aa, Citrus sinensis
MPDQKHCLLAIPCEATHPDALRAALAEFISTLIFVFAGEGSGMAFNKLTHNGANTPSGLVAASVAHAFALFVAVAVGANISGGHVNPAVTFGAFVGGNISLLRGILYWIAQLLGSTVACLLLKFVTNGQTTSAFALSSGVGAWNAVVFEIVMTFGLVYTVYATALDPKKGSLGTIAPIAIGFIVGANILAGGAFDGASMNPAVSFGPALVSWSWDNHWVYWVGPLIGGGLAGIVYEFFFINQSHEQLPTTEY

SEQ ID NO: 818 - protein, 252 aa, Gossypium hirsutum
MPISRIAVGSAAEAGQADALKAALAEFISMLIFVFAGEGSGMAFNKLTDNGSTTPAGLVAASVAHAFALFVAVSVGANISGGHVNPAVTFGAFVGGHITLVRSILYWIAQLLGSVVACLLLKFSTGGLTTSAFALSSGVGAWNAVVFEIVMTFGLVYTVYATAVDPKKGNIGIIAPIAIGFIVGANILAGGAFDGASMNPAVSFGPAVVSWTWDNHWVYWLGPFVGSAIAAIVYEVFFIAPDTHEQLPTSEF

SEQ ID NO: 819 - protein, 252 aa, Taraxacum officinale
MPISSISLGSPADASSPDALKAALAEFISMLIFVFAGEGAGMAFGKLTDGGATTPAGLISASIAHAFALFVAVSVGANISGGHVNPAVTFGAFVGGHISFMRSVLYWIAQCLGSVVACLLLKFATGGLETSAFALSSGVGEWNAVVFEIVMTFGLVYTVYATAVDPKKGDLGIIAPLAIGFIVGANILAGGAFDGASMNPAVSFGPAVVSWTWNNHWVYWLGPFVGAAIAALIYEIIFIGSSTHEPLPITDY

SEQ ID NO: 820 - protein, 252 aa, Festuca arundinacea
  misc_feature (225)..(225): Xaa can be any naturally occurring amino acid
MPVSKIAIGSPGELSHPDTFRAGVAEFISMLIFVFAGSGSGMAFGKLTDGGPTTPAGLIAAALAHALALFVAVSVGANISGGHVNPAVTFGAFVGGNISLLKAVVYWIAQLLGSVVACLLLKIATGGEAVGAFSLSAGVGVWNAVVFEIVMTFGLVYTVYATAVDPKKGDLGTIAPIAIGFIVGANILAGGAFDGASMNPAVSFGPAVVSGVWENHWVYWLGPFXGAAIAALIYDIIFIGQRPHEQLPTADY

SEQ ID NO: 821 - protein, 251 aa, Festuca arundinacea
  misc_feature (123)..(123): Xaa can be any naturally occurring amino acid
MPVSRIAIGSPGELSHPDTFRAGVAEFISMLIFVFAGSGSGMAFAKLSDGGPTTPAGLIAAALAHALALFVAVSVGANISGGHVNPAVTFGAFVGGNISLLKAVVYWVAQLLGSVVACLLLKXATGGEAVGAFSLSAGVGVWNALVLEIVMTFGLVYTVYATAVDPKKGELGTIAPIAIGFIVGANILVGGAFSGASMNPAVSFGPALVSWEWGYQWVYWVGPLIGGGLAGVVYELLFINRSHEQLPTTDY

SEQ ID NO: 822 - protein, 251 aa, Vitis vinifera
MPINRIAIGTPGEASHPDALKAALAEFFSMLIFVFAGEGSGMAFNKLTDSGSSTPAGLVAAALAHGFALFVAVSVGANISGGHVNPAVTFGAFIGGHITLLRGILYWIAQLLGSVVACLLLKFSTGGLETSAFSLSSGVSVWNALVFEIVMTFGLVYTVYATAVDPKKGNLGIIAPIAIGFIVGANILAGGAFDGASMNPAVSFGPAVVSWSWANHWVYWAGPLIGAAIAAIIYDHIFIDSTHEQLPTTDY

SEQ ID NO: 823 - protein, 252 aa, Ipomoea nil
MPIHRIAIGAPAEASHPDALKAALAEFFSMLIFVFAGQGSGMAFSKLTDGGAATPAGLIAAALAHALALFVAVSVGANISGGHVNPAVTFGAFLGGNITLLRGILYWIAQLLGSVVACLLLKLATGGLETSAFALSSGVSVWNALIFEIVMTFGLVYTVYATAVDPKKGDLGTIAPIAIGFIVGANILAGGAFDGASMNPAVSFGPAVVSWTWTCHWVYWLGPLVGAAIAALVYDNIFIGTHHHEQLPIADY

SEQ ID NO: 824 - protein, 252 aa, Lactuca sativa
  misc_feature (56)..(56): Xaa can be any naturally occurring amino acid
MPISSIAIGTPAEASSPDALKAALAEFISMLIFVFAGEGAGMAFGKLTDGGAATPXGLISASIAHAFALFVAVSVGANISGGHVNPAVTFGLFVGGHISFLRSVVYWIAQCLGSVVACLLLKFATGGLETSAFALSSGVGEWNAVVFEIVMTFGLVYTVYATAVDPKKGDLGIIAPLAIGFIVGANILAGGAFDGASMNPAVSFGPAVVSWTWNSHWVYWLGPFVGAGIAALVYEIIFIGSSTHEPLTTVDY

SEQ ID NO: 825 - protein, 251 aa, Lotus japonicus
MPIRNIAIGAPQEATHPDTLRSALAEFISTFIFVFAGSGSGIAYNKLTDDGAATPAGLISASIAHAFALFVAVSISANISGGHVNPAVTFGLFVGGNISFLRGVIYIIAQLLGSIVASLLLAFVTGLAVPAFGLSAGVGVGNALVLEIVMTFGLVYTVYATAVDPKKGSLGTIAPIAIGFIVGANILLGGAFDGASMNPAVSFGPAVVSWSWSNHWIYWVGPLVGGGIAGLIYEVVFIGSQTHEQLPTTDY

SEQ ID NO: 826 - protein, 250 aa, Medicago truncatula
MPIRNIAVGTPQEATHPDTLKAGLAEFISTFIFVFAGSGSGIAYNKLTNDGAATPAGLISASIAHAFALFVAVSVGANISGGHVNPAVTFGAFVGGNITLLRGIVYIIAQLLGSIVASALLVFVTASSVPAFGLSEGVGVGPALVLEIVMTFGLVYTVYATAVDPKKGNIGIIAPIAIGFIVGANILVGGAFTGASMNPAVSFGPAVVSWSWSNHWVYWAGPLIGGGIAGLVYEVLFINSTHEQLPTTDY

SEQ ID NO: 827 - protein, 252 aa, Medicago truncatula
  misc_feature (116)..(116): Xaa can be any naturally occurring amino acid
MPISRIAIGNPSEFGKADALKAALAEFISMLIFVFAGEGSGMAYNKLTNNGAATPAGLVAASLSHAFALFVAVSVGANISGGHVNPAVTFGAFIGGHITLIRGLLYWIAQLLGSVXACLLLKIATGGLETSAFSLSSGVGATNALVFEIVMTFGLVYTVYATAVDPKNGSLGTIAPIAIGFIVGANILAGGAFDGASMNPAVSFGPAVVSWTWANHWVYWVGPLIGSAIAAVVYETFFITPSSYEQLPVTDY

SEQ ID NO: 828 - protein, 250 aa, Arachis hypogaea
MPIRNIAIGRPEEATHPDTLKAGLAEFISTLIFVFAGSGSSIAYNKLTNDGAATPAGLIAAAIAHAFALFVAVSVGANISGGHVNPAVTFGAFVGGNITFLRGIVYVIAQLLGSIVAALLLKFVTASTVPAFALSSGVGVGEALVLEIVLTFGLVYTVYATAVDPKKGSLGTIAPIAIGFIVGANILVGGAFDGASMNPAVSFGPAVVSWSWSNHWIYWVGPLIGGGIAGVIYEVLFISHTHEQLPTTDY

SEQ ID NO: 829 - protein, 250 aa, Petunia hybrida
MPINQISLGSHEELRHSGALKAALAEFISTLIFVFAGQGSGMAYNKLTADGAASPAGLISASLAHAFGLFVAVSVGANISGGHVNPAVTFGAFIGGNITFFRGILYIIAQLLGSTAACFILEFTTGMSTGSFALSDGVGVWNALVFEIVMTFGLVYTVYATAVDPKKGDLGVIAPIAIGFIVGANILAGGAFTGASMNPAVSFGPSLVSWTWTHQWIYWAGPIIGGGLAGVVYELLFINHSHEPLPSGDF

SEQ ID NO: 830 - protein, 250 aa, Oryza sativa
MPIRNIAVGSHQEVYHPGALKAALAEFISTLIFVFAGQGSGMAFSKLTGGGATTPAGLIAAAVAHAFALFVAVSVGANISGGHVNPAVTFGAFVGGNITLFRGLLYWIAQLLGSTVACFLLRFSTGGLATGTFGLTGVSVWEALVLEIVMTFGLVYTVYATAVDPKKGSLGTIAPIAIGFIVGANILVGGAFDGASMNPAVSFGPALVSWSWESQWVYWVGPLIGGGLAGVIYEVLFISHTHEQLPTTDY

SEQ ID NO: 831 - protein, 250 aa, Sorghum bicolor
MPISRIAVGTHHEVYHPGALKAALAEFISTLIFVFAGQGSGMAFSKLTSGGATTPSGLIAAAVAHAFALFVAVSVGANISGGHVNPAVTFGAFVGGNITLFRGLLYWVAQLLGSTVACFLLRFSTGGLATGTFGLTGVSVWEAVVMEIVMTFGLVYTVYATAVDPKKGSLGTIAPIAIGFIVGANILVGGAFTGASMNPAVSFGPALVSWEWGYQWVYWVGPLIGGGLAGVIYELLFISQTHEQLPTTDY

SEQ ID NO: 832 - protein, 250 aa, Glycine max
MPIRNIAVGRPEEATHPDTLKAALAEFISTFIFVFAGSGSGIAYNKLTDNGAATPAGLISASIAHAFALFVAVSVGANISGGHVNPAVTFGAFVGGNITFLRGIVYVIAQLLGSIVASLLLAFVTASTVPAFGLSAGVGVGNALVLEIVMTFGLVYTVYATAIDPKKGNLGIIAPIAIGFIVGANILLGGAFSGAAMNPAVTFGPAVVSWTWTNHWIYWAGPLIGGGIAGLVYEVVFISHTHEQLPTTDY

SEQ ID NO: 833 - protein, 250 aa, Glycine max; identical to SEQ ID NO: 832

SEQ ID NO: 834 - protein, 250 aa, Glycine max
MPIRNIAIGRPEEATHPDTLKAGLAEFISTLIFVFAGSGSGIAYNKLTDNGAATPAGLISASIAHAFALFVAVSVGANISGGHVNPAVTFGAFVGGNITLLRGIVYVIAQLLGSIVASLLLAFVTASPVPAFGLSAGVGVGNALVLEIVMTFGLVYTVYATAVDPKKGNLGIIAPIAIGFIVGANILLGGAFSGAAMNPAVTFGPAVVSWTWTNHWIYWAGPLIGGGIAGLIYEVVFISHTHEQLPSTDY

SEQ ID NO: 835 - protein, 252 aa, Glycine max
MPISRIAIGNSSELNQSDALKAALAEFISMLIFVLPGEGSGMAYNKLTNNGSATPAGLVAASLSHAFALFVAVSVGANISGGHVNPAVTFGAFVGGHITLFRSILYWIAQLLGSVVACLLLKFATGGLETSAFALSPGVEAGNALVFEIVMTFGLVYTVYATAVDPKKGDLGIIAPIAIGFIVGANILAGGAFDGASMNPAVSFGPAVVSWTWSNHWVYWVGPFAGAAIAAIVYEIFFISPNTHEQLPVTDY

SEQ ID NO: 836 - protein, 252 aa, Euphorbia esula; identical to SEQ ID NO: 771
  misc_feature (216)..(216): Xaa can be any naturally occurring amino acid
  misc_feature (227)..(227): Xaa can be any naturally occurring amino acid
  misc_feature (235)..(235): Xaa can be any naturally occurring amino acid

SEQ ID NO: 837 - protein, 250 aa, Saccharum officinarum
MPISRIAVGTHHEVYHPGALKAAIAEFICTLIFVFAGQGSGMAFSKLTSGGATTPSGLIAAALAHAFALFVAVSVGANISGGHVNPAVTFGAFVGGNITLFRGLLYWVAQLLGSTVACFLLRFSTGGLATGTFGLTGVSVWEALVLEIVMTFGLVYTVYATAVDPKKGSLGTIAPIAIGFIVGANILVGGAFTGASMNPAVSFGPALVSWEWGYQWVYWVGPLIGAGIAGVIYELLFISHTHEQLPTTDY

SEQ ID NO: 838 - protein, 250 aa, Saccharum officinarum; identical to SEQ ID NO: 837

SEQ ID NO: 839 - protein, 252 aa, Nicotiana tabacum
MPISKISLGNLAEASQPDALKAALAEFISMLIFVFAGEGSGMAFGKLTNGGAATPAGLISAAIAHAFALFVAVSVGANISGGHVNPAVTFGAFVGGHITLFRSVLYWIAQLLGSVVACVLLKFATGGLETSAFALSTGVTPWNAVVFEIVMTFGLVYTVYATAIDPKRGNLGIIAPIAIGFIVGANILAGGAFDGASMNPAVSFGPAVVSWTWNSHWVYWLGPFVGAAIAALVYEIIFIGDNTHEQLPTADY

SEQ ID NO: 840 - protein, 251 aa, Nicotiana tabacum
MPIHQIAVGSHEELRQPGTLKAALAEFICTLIFVFAGQGSGMAFNKLSVDGTATPSGLISASIAHAFGLFVAVSVGANISGGHVNPAVTFGAFVGGNITLFRGILYIIAQLLGSTVACFLLEFATGGMSTGAFALSAGVSVWNAFVFEIVMTFGLVYTVYATAIDPKKGDLGVIAPIAIGFIVGANILAGGAFTGASMNPAVSFGPALVSWTWTHQWVYWAGPLVGGGIAGVVYELIFINHSHEPLPSGDF

SEQ ID NO: 841 - protein, 251 aa, Nicotiana tabacum
MPIHQIAVGSHEELRQSGTLKAALAEFICTLIFVFAGQGSGMAFNKLSADGTATPAGLISASIAHAFGLFVAVSVGANISGGHVNPAVTFGAFVGGNITLFRGILYIVAQLLGSTVACFLLEFATGGMSTGAFALSAGVSVWNAFVFEIVMTFGLVYTVYATAVDPKKGDLGVIAPIAIGFIVGANILAGGAFTGASMNPAVSFGPALVSWTWTHQWVYWAGPLVGGGIAGVVYELIFINHSHEPLPSGDF

SEQ ID NO: 842 - protein, 252 aa, Nicotiana tabacum
MPISKITLGNLAEASQPDALKAALAEFISMLIFVFAGEGSGMAFGKLTNGGAATPAGLISAAIAHAFALFVAVSVGANISGGHVNPAVTFGAFVGGHITLFRSVLYWIAQLLGSVVACVLLKFATGGLETSAFALSTGVTPWNAVVFEIVMTFGLVYTVYATAVDPKRGNLGIIAPIAIGFIVGANILAGGAFDGASMNPAVSFGPAVVSWTWNSHWVYWLGPFVGAATAALVYEIIFIGDNTHEQLPTADY

SEQ ID NO: 843 - protein, 250 aa, Triticum aestivum
MPVSRIAVGSHREVYEVGALKAALAEFISTLIFVFAGQGSGMAFSKLSPDGAATPAGLISAAIAHAFALFVAVSVGANISGGHVNPAVTFGAFVGGNITLFRGLLYWVAQLLGSTAACFLLRFSTGGLPTGTFGLTGIGAWEAVVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPTTDY

SEQ ID NO: 844 - protein, 253 aa, Solanum lycopersicum
MPISRIAIGNLAEATKPDALKAATAEFFSMLIFVFAGSGSGMAFGKLTNGGAATPAGLISASIAHAFALFVAVSVGANISGGHVNPAVTFGAFVGGHITLFRSVLYWIAQLLGSVVACVLLKFSTGGLETSAFALSSGVTPWNAVVFEIVMTFGLVYTVYATAVDPKKGDLGIIAPIAIGFIVGANILAGGAFDGASMNPAVSFGPAVVSWTWDNHWVYWLGPFGGAAIAALVYEIIFIGQNTHEQLPTTDDY

SEQ ID NO: 845 - protein, 250 aa, Solanum lycopersicum
MPINQITIGSHEELRHPGALKAALAEFISTLIFVFAGQGSGMAFNKLTDGVATPAGLISASIAHAFGLFVAVSVGANISGGHVNPAVTFGAFVGGNITLFRGILYIIAQLLGSTAACALLEFATGGMSTGSFALSAGVSVWNAFVFEIVMTFGLVYTVYATAVDPKKGDLGVIAPIAIGFIVGANILAGGAFTGASMNPAVSFGPSLVSWTWTHQWVYWAGPLIGGGLAGFIYEFIFISHTHEQIPSGDF

SEQ ID NO: 846 - protein, 253 aa, Solanum lycopersicum; identical to SEQ ID NO: 844

SEQ ID NO: 847 - protein, 250 aa, Solanum lycopersicum; identical to SEQ ID NO: 845

SEQ ID NO: 848 - protein, 252 aa, Triticum aestivum
MPVSRIAIGAPGELSHPDTFRAGVAEFISMLIFVFAGSGSGMAFGKLTDGGATTPAGLIAAALAHAFALFVAVSVGANISGGHVNPAVTFGAFVGGNISLLKAVVYWVAQLLGSVVACLLLKIATGGEAVGAFSLSAGVGVWNAVVFEIVMTFGLVYTVYATAVDPKRGDLGVIAPIAIGFIVGANILAGGAFDGASMNPAVSFGPAVVSGVWENHWVYWLGPFAGAAIAALVYDICFIGQRPHEQLPTADY

SEQ ID NO: 849 - protein, 252 aa, Triticum aestivum
MPVSRIAIGAPGELSHPDTFRAGVAEFISMLIFVFAGSGSGMAFGKLTDGGATTPAGLIAAALAHAFALFVAVSVGANISGGHVNPAVTFGAFVGGNISLLKAVVYWVAQLLGSVVACLLLKIATGGEAVGAFSLSAGVGVWNAVVFEIVMTFGLVYTVYATAVDPKRGDLGVIAPIAIGFIVGANILAGGAFDGASMNPAVSFGPAVVTGVWENHWVYWLGPFAGAAIAALVYDICFIGQRPHEQLPTADY

SEQ ID NO: 850 - protein, 250 aa, Zea mays
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSTVACFLLRFSTGGQATGTFGLTGVSVWEALVLEIVMTFGLVYTVYATAVDPKKGSLGTIAPIAIGFIVGANILVGGAFDGASMNPAVSFGPALVSWEWGYQWVYWVGPLIGGGLAGVIYELLFISHTHEQLPSTDY

SEQ ID NO: 851 - protein, 333 aa, Arabidopsis thaliana; identical to SEQ ID NO: 447

SEQ ID NO: 852 - protein, 333 aa, Arabidopsis thaliana; identical to SEQ ID NO: 62

SEQ ID NO: 853 - DNA, 24 bp, Artificial sequence
  Single strand DNA oligonucleotide
gctatacaacatgggagttatacc

SEQ ID NO: 854 - DNA, 20 bp, Artificial sequence
  Single strand DNA oligonucleotide
ctatcgacagtgctggtaca

SEQ ID NO: 855 - DNA, 23 bp, Artificial sequence
  Single strand DNA oligonucleotide
gcgagcacagaattaatacgact

SEQ ID NO: 856 - DNA, 32 bp, Artificial sequence
  Single strand DNA oligonucleotide
cgcggatccgaattaatacgactcactatagg

SEQ ID NO: 857 - DNA, 23 bp, Artificial sequence
  Single strand DNA oligonucleotide
tgcagtctaaatacgatggatca

SEQ ID NO: 858 - DNA, 22 bp, Artificial sequence
  Single strand DNA oligonucleotide
gagtaggaacacttacattcga

SEQ ID NO: 859 - DNA, 23 bp, Artificial sequence
  Single strand DNA oligonucleotide
gcgagcacagaattaatacgact

SEQ ID NO: 860 - DNA, 32 bp, Artificial sequence; identical to SEQ ID NO: 856
  Single strand DNA oligonucleotide

SEQ ID NO: 861 - DNA, 21 bp, Artificial sequence
  Single strand DNA oligonucleotide
tctcaagaagctcttcgtgga

SEQ ID NO: 862 - DNA, 20 bp, Artificial sequence
  Single strand DNA oligonucleotide
gaggaagaatctgagccgat

SEQ ID NO: 863 - DNA, 23 bp, Artificial sequence
  Single strand DNA oligonucleotide
gcgagcacagaattaatacgact

SEQ ID NO: 864 - DNA, 32 bp, Artificial sequence; identical to SEQ ID NO: 856
  Single strand DNA oligonucleotide

SEQ ID NO: 865 - DNA, 31 bp, Artificial sequence
  Single strand DNA oligonucleotide
aatgtcgacagaaaatgggagtcatgatcaa

SEQ ID NO: 866 - DNA, 32 bp, Artificial sequence
  Single strand DNA oligonucleotide
aatgtcgactgctatagaaaatgggagtcatg

SEQ ID NO: 867 - DNA, 31 bp, Artificial sequence
  Single strand DNA oligonucleotide
tatctagatcatcaaacggtttcaggacgag

SEQ ID NO: 868 - DNA, 29 bp, Artificial sequence
  Single strand DNA oligonucleotide
tatctagatgacacttcaaacggtttcag

SEQ ID NO: 869 - DNA, 29 bp, Artificial sequence
  Single strand DNA oligonucleotide
acggtcgacacttgatgacaatgggcgac

SEQ ID NO: 870 - DNA, 37 bp, Artificial sequence
  Single strand DNA oligonucleotide
tcccgggttattacctacaagtagatgattctacacc

SEQ ID NO: 871 - DNA, 30 bp, Artificial sequence
  Single strand DNA oligonucleotide
aatctagatctcaatggcttctaattaccg

SEQ ID NO: 872 - DNA, 29 bp, Artificial sequence
  Single strand DNA oligonucleotide
agagctcgtgtcttactcacatcccttgg

SEQ ID NO: 873 - DNA, 29 bp, Artificial sequence
  Single strand DNA oligonucleotide
tgagctctgccacgtgtcttactcacatc

SEQ ID NO: 874 - DNA, 31 bp, Artificial sequence
  Single strand DNA oligonucleotide
aatgtcgacctataatggctggaatgtgttg

SEQ ID NO: 875 - DNA, 36 bp, Artificial sequence
  Single strand DNA oligonucleotide
tatctagattacccatactgttatagattttttctc

SEQ ID NO: 876 - DNA, 30 bp, Artificial sequence
  Single strand DNA oligonucleotide
tatctagacatcaacaaaggcagctaaatc

SEQ ID NO: 877 - DNA, 31 bp, Artificial sequence
  Single strand DNA oligonucleotide
aatgtcgacaaacaatggcgaataagttcac

SEQ ID NO: 878 - DNA, 30 bp, Artificial sequence
  Single strand DNA oligonucleotide
tatctagatcatcaagaaaacaacgcttcg

SEQ ID NO: 879 - DNA, 33 bp, Artificial sequence
  Single strand DNA oligonucleotide
agcgtcgaccaaatatgactgtgatgaatcacc

SEQ ID NO: 880 - DNA, 34 bp, Artificial sequence
  Single strand DNA oligonucleotide
atagtcgacaaagagatcttcacaaatatgactg

SEQ ID NO: 881 - DNA, 36 bp, Artificial sequence
  Single strand DNA oligonucleotide
tatctagactactatctcttataagttgcaaccaag

SEQ ID NO: 882 - DNA, 29 bp, Artificial sequence
  Single strand DNA oligonucleotide
tatctagaatagaaatggcaaaatgggtg

SEQ ID NO: 883 - DNA, 29 bp, Artificial sequence
  Single strand DNA oligonucleotide
aatgtcgacctgcaatggcttctcctctt

SEQ ID NO: 884 - DNA, 32 bp, Artificial sequence
  Single strand DNA oligonucleotide
taagtcgacgatctctctctgcactctctgac

SEQ ID NO: 885 - DNA, 31 bp, Artificial sequence
  Single strand DNA oligonucleotide
tatctagatcaatctcagactcgaacgcgtg

SEQ ID NO: 886 - DNA, 31 bp, Artificial sequence
  Single strand DNA oligonucleotide
tatctagacttcaacaatctcagactcgaac

SEQ ID NO: 887 - DNA, 29 bp, Artificial sequence
  Single strand DNA oligonucleotide
agagctcaggaaaatgacagaatcgagtc

SEQ ID NO: 888 - DNA, 32 bp, Artificial sequence
  Single strand DNA oligonucleotide
aatgtcgacggagaggttactgatctgaattg

SEQ ID NO: 889 - DNA, 29 bp, Artificial sequence
  Single strand DNA oligonucleotide
agagctcaggaaaatgacagaatcgagtc

SEQ ID NO: 890 - DNA, 30 bp, Artificial sequence
  Single strand DNA oligonucleotide
tgagctcagcttaggtgtatgaacattctg

SEQ ID NO: 891 - DNA, 29 bp, Artificial sequence
  Single strand DNA oligonucleotide
aatgtcgactccaattccatcttcccatg

SEQ ID NO: 892 - DNA, 30 bp, Artificial sequence
  Single strand DNA oligonucleotide
aatgtcgacctctcctctgctctccaattc

SEQ ID NO: 893 - DNA, 29 bp, Artificial sequence
  Single strand DNA oligonucleotide
tcccgggtcatcattcgaggatcgtccca

SEQ ID NO: 894 - DNA, 29 bp, Artificial sequence
  Single strand DNA oligonucleotide
tcccgggcttataatcattcgaggatcgt

SEQ ID NO: 895 - DNA, 29 bp, Artificial sequence
  Single strand DNA oligonucleotide
aatgtcgacggataatggcttcgtatggc

SEQ ID NO: 896 - DNA, 30 bp, Artificial sequence
  Single strand DNA oligonucleotide
tcccgggttatcagtttctcttggcgatga

SEQ ID NO: 897 - DNA, 28 bp, Artificial sequence
  Single strand DNA oligonucleotide
taggtcgactagccatggacaacgaagg

SEQ ID NO: 898 - DNA, 34 bp, Artificial sequence
  Single strand DNA oligonucleotide
tatctagattattagccactaggattatcaagtc

SEQ ID NO: 899 - DNA, 26 bp, Artificial sequence
  Single strand DNA oligonucleotide
aatctagatccgatcatgccgaccag

SEQ ID NO: 900 - DNA, 30 bp, Artificial sequence
  Single strand DNA oligonucleotide
tgagctcttatcagtaatcggtggtaggca

SEQ ID NO: 901 - DNA, 31 bp, Artificial sequence
  Single strand DNA oligonucleotide
tgagctccagattaacaacgttgaatttgac

SEQ ID NO: 902 - DNA, 31 bp, Artificial sequence
  Single strand DNA oligonucleotide
aaggtcgaccgagagagacagagaggtttcg

SEQ ID NO: 903 - DNA, 30 bp, Artificial sequence
  Single strand DNA oligonucleotide
atagtcgaccgaagtttgagctaagaatcc

SEQ ID NO: 904 - DNA, 32 bp, Artificial sequence
  Single strand DNA oligonucleotide
tatctagattattattctccatggtcgtgaag

SEQ ID NO: 905 - DNA, 30 bp, Artificial sequence
  Single strand DNA oligonucleotide
tatctagatagctattattctccatggtcg

SEQ ID NO: 906 - DNA, 30 bp, Artificial sequence
  Single strand DNA oligonucleotide
aatgtcgacccaggatgaagttcatttctg

SEQ ID NO: 907 - DNA, 29 bp, Artificial sequence
  Single strand DNA oligonucleotide
aatgtcgactctctccatctcccatccag

SEQ ID NO: 908 - DNA, 34 bp, Artificial sequence
  Single strand DNA oligonucleotide
tatctagatcatcgcatcactcagtcaaacaaac

SEQ ID NO: 909 - DNA, 29 bp, Artificial sequence
  Single strand DNA oligonucleotide
tatctagagatgatagaagaggtgaccgc

SEQ ID NO: 910 - DNA, 27 bp, Artificial sequence
  Single strand DNA oligonucleotide
aatgtcgacggcgaatggctggatttc

SEQ ID NO: 911 - DNA, 31 bp, Artificial sequence
  Single strand DNA oligonucleotide
tgagctcttatcagtcctgatgtgtctgctg

SEQ ID NO: 912 - DNA, 31 bp, Artificial sequence
  Single strand DNA oligonucleotide
aatgtcgacaacaatggagagcgagatggcg

SEQ ID NO: 913 - DNA, 31 bp, Artificial sequence
  Single strand DNA oligonucleotide
aatgtcgacgaggaggaacaaacaactcatc

SEQ ID NO: 914 - DNA, 31 bp, Artificial sequence
  Single strand DNA oligonucleotide
tgagctctcatcattgaatcatcggatcacc

SEQ ID NO: 915 - DNA, 27 bp, Artificial sequence
  Single strand DNA oligonucleotide
tgagctcgcaggtcattgaatcatcgg

SEQ ID NO: 916 - DNA, 27 bp, Artificial sequence
  Single strand DNA oligonucleotide
attctagaaaaccatgaccgtcgtctc

SEQ ID NO: 917 - DNA, 33 bp, Artificial sequence
  Single strand DNA oligonucleotide
cttctagaggtctcttctcagatactcattcac

SEQ ID NO: 918 - DNA, 31 bp, Artificial sequence
  Single strand DNA oligonucleotide
tgagctcttattagaatctgcagaaagctag

SEQ ID NO: 919 - DNA, 29 bp, Artificial sequence
  Single strand DNA oligonucleotide
tgagctcagatgtcaaagagggcttactc

SEQ ID NO: 920 - DNA, 30 bp, Artificial sequence
  Single strand DNA oligonucleotide
aatgtcgaccagtgatgaggaagctcaaga

SEQ ID NO: 921 - DNA, 28 bp, Artificial sequence
  Single strand DNA oligonucleotide
atagtcgaccgttgtttgcaccaccttg

SEQ ID NO: 922 - DNA, 33 bp, Artificial sequence
  Single strand DNA oligonucleotide
tatctagattattaagcaagcatgtcgtagtca

SEQ ID NO: 923 - DNA, 33 bp, Artificial sequence
  Single strand DNA oligonucleotide
tctctagattagatcttttaagcaagcatgtcg

SEQ ID NO: 924 - DNA, 30 bp, Artificial sequence
  Single strand DNA oligonucleotide
acggtcgactccacatgacttcagatgctc

SEQ ID NO: 925 - DNA, 31 bp, Artificial sequence
  Single strand DNA oligonucleotide
actgtcgacgaacatcacccaattctctagc

SEQ ID NO: 926 - DNA, 32 bp, Artificial sequence
  Single strand DNA oligonucleotide
tatctagactactagccggtgacaaagtaatc

SEQ ID NO: 927 - DNA, 36 bp, Artificial sequence
  Single strand DNA oligonucleotide
tatctagactaatcgttggttgatgtgtcactctag

SEQ ID NO: 928 - DNA, 30 bp, Artificial sequence
  Single strand DNA oligonucleotide
tagatatcaaaagatgcaagttgtttctcc

SEQ ID NO: 929 - DNA, 33 bp, Artificial sequence
  Single strand DNA oligonucleotide
tagatatcctgtgtgtttgtatttatttggatc

SEQ ID NO: 930 - DNA, 36 bp, Artificial sequence
  Single strand DNA oligonucleotide
tagatatctcatgatgatcagtaaggatgaacattc

SEQ ID NO: 931 - DNA, 35 bp, Artificial sequence
  Single strand DNA oligonucleotide
tagatatctcagcaagaaggtgatgatcagtaagg

SEQ ID NO: 932 - DNA, 31 bp, Artificial sequence
  Single strand DNA oligonucleotide
ttggtcgaccgtagacacgtattttgaaggg

SEQ ID NO: 933 - DNA, 31 bp, Artificial sequence
  Single strand DNA oligonucleotide
tatgtcgacttaatggtagaccgtagacacg

SEQ ID NO: 934 - DNA, 36 bp, Artificial sequence
  Single strand DNA oligonucleotide
caatctagattaatgctctcaagagacacaataagc

SEQ ID NO: 935 - DNA, 35 bp, Artificial sequence
  Single strand DNA oligonucleotide
cttctagattaggtcatcaaatattgtatagatcg

SEQ ID NO: 936 - DNA, 30 bp, Artificial sequence
  Single strand DNA oligonucleotide
tttgtcgactcagcttcagatggtgattcc

SEQ ID NO: 937 - DNA, 32 bp, Artificial sequence
  Single strand DNA oligonucleotide
tttctagatcatcagagcaacttgacaccagc

SEQ ID NO: 938 - DNA, 30 bp, Artificial sequence
  Single strand DNA oligonucleotide
acccgggagaagatgaagctaaaatgggaa

SEQ ID NO: 939 - DNA, 27 bp, Artificial sequence
  Single strand DNA oligonucleotide
acccggggtatatctctcagcgcgagg

SEQ ID NO: 940 - DNA, 31 bp, Artificial sequence
  Single strand DNA oligonucleotide
tgagctcttattatttaccggttcgaccatt

SEQ ID NO: 941 - DNA, 32 bp, Artificial sequence
  Single strand DNA oligonucleotide
tgagctcttagccattgactacatacaagcaa

SEQ ID NO: 942 - DNA, 27 bp, Artificial sequence
  Single strand DNA oligonucleotide
tagatatcaccttggaacgattttgcc

SEQ ID NO: 943 - DNA, 28 bp, Artificial sequence
  Single strand DNA oligonucleotide
gagatatcaaagctctgaccttggaacg

SEQ ID NO: 944 - DNA, 37 bp, Artificial sequence
  Single strand DNA oligonucleotide
cagatatcttatcataagtacaaatcagtctgctcac

SEQ ID NO: 945 - DNA, 36 bp, Artificial sequence
  Single strand DNA oligonucleotide
tagatatctcacattcataagtacaaatcagtctgc

SEQ ID NO: 946 - DNA, 29 bp, Artificial sequence
  Single strand DNA oligonucleotide
ttgatatcagtttctccgtcgacgatacc

SEQ ID NO: 947 - DNA, 33 bp, Artificial sequence
  Single strand DNA oligonucleotide
aagatatcggtcaagtacataagctaatagatg

SEQ ID NO: 948 - DNA, 35 bp, Artificial sequence
  Single strand DNA oligonucleotide
aatgtcgacaacaatggtgcttctacttgtgattg

SEQ ID NO: 949 - DNA, 32 bp, Artificial sequence
  Single strand DNA oligonucleotide
tgagctctcacttccactagtcactacaagcg

SEQ ID NO: 950 - DNA, 33 bp, Artificial sequence
  Single strand DNA oligonucleotide
ctggtcgacacagtattgagagacttcctggtg

SEQ ID NO: 951 - DNA, 29 bp, Artificial sequence
  Single strand DNA oligonucleotide
gcttctagacaatgtgaactaaatcgacc

SEQ ID NO: 952 - DNA, 24 bp, Artificial sequence
  Single strand DNA oligonucleotide
agagctcgttttcttcgccatggc

SEQ ID NO: 953 - DNA, 31 bp, Artificial sequence
  Single strand DNA oligonucleotide
tgagctcttaaacagtgactaccacagtgca

SEQ ID NO: 954 - DNA, 31 bp, Artificial sequence
  Single strand DNA oligonucleotide
tcgatatcggaatcagaatcttttcagatgg

SEQ ID NO: 955 - DNA, 31 bp, Artificial sequence
  Single strand DNA oligonucleotide
ctgatatcgagtttctcttccttaattgtcg

SEQ ID NO: 956 - DNA, 28 bp, Artificial sequence
  Single strand DNA oligonucleotide
ttgatatcatcatcagcttggaacctcg

SEQ ID NO: 957 - DNA, 28 bp, Artificial sequence
  Single strand DNA oligonucleotide
tagatatctctttccatcgatcatcagc

SEQ ID NO: 958 - DNA, 30 bp, Artificial sequence
  Single strand DNA oligonucleotide
ctagtcgactaacaacaatggagaaccctc

SEQ ID NO: 959 - DNA, 33 bp, Artificial sequence
  Single strand DNA oligonucleotide
actctagattaatgatcaaccaattggtcttag

SEQ ID NO: 960 - DNA, 26 bp, Artificial sequence
  Single strand DNA oligonucleotide
tatctagaagaaaatggcgatgcgac

SEQ ID NO: 961 - DNA, 35 bp, Artificial sequence
  Single strand DNA oligonucleotide
tatctagatcatcacacatcctgagatacttcatc

SEQ ID NO: 962 - DNA, 31 bp, Artificial sequence
  Single strand DNA oligonucleotide
aatgtcgacagagaaatgttggctatcttcc

SEQ ID NO: 963 - DNA, 32 bp, Artificial sequence
  Single strand DNA oligonucleotide
tatctagatcatcagagagaccaattggcttc

SEQ ID NO: 964 - DNA, 30 bp, Artificial sequence
  Single strand DNA oligonucleotide
aatgtcgactttgaatggaaccatcatctg

SEQ ID NO: 965 - DNA, 32 bp, Artificial sequence
  Single strand DNA oligonucleotide
ttagtcgacctgaatctgtttttgaatggaac

SEQ ID NO: 966 - DNA, 31 bp, Artificial sequence
  Single strand DNA oligonucleotide
tatctagattattaggtggaaagaacaagcg

SEQ ID NO: 967 - DNA, 37 bp, Artificial sequence
  Single strand DNA oligonucleotide
tatctagatcaacaagacaagataatgaaagacacag

SEQ ID NO: 968 - DNA, 27 bp, Artificial sequence
  Single strand DNA oligonucleotide
tagatatcttaaaatgccggagaaagg

SEQ ID NO: 969 - DNA, 35 bp, Artificial sequence
  Single strand DNA oligonucleotide
atgatatcctactatcttacacacaatgcattcag

SEQ ID NO: 970 - DNA, 29 bp, Artificial sequence
  Single strand DNA oligonucleotide
atagtcgacgaaacatggttgaatcggac

SEQ ID NO: 971 - DNA, 34 bp, Artificial sequence
  Single strand DNA oligonucleotide
tatctagattagacactttatgcctcctttgtag

SEQ ID NO: 972 - DNA, 31 bp, Artificial sequence
  Single strand DNA oligonucleotide
agcgtcgacttagagagagatgcagaaacgg

SEQ ID NO: 973 - DNA, 34 bp, Artificial sequence
  Single strand DNA oligonucleotide
cgagctcctaatctagagaagacttttacatgcc

SEQ ID NO: 974 - DNA, 33 bp, Artificial sequence
  Single strand DNA oligonucleotide
aatgtcgaccatcctcatgaataattctacatc

SEQ ID NO: 975 - DNA, 30 bp, Artificial sequence
  Single strand DNA oligonucleotide
actgtcgacgcattccattcatcctcatga

SEQ ID NO: 976 - DNA, 32 bp, Artificial sequence
  Single strand DNA oligonucleotide
attctagagtgtgattatcagtttgttctctc

SEQ ID NO: 977 - DNA, 31 bp, Artificial sequence
  Single strand DNA oligonucleotide
attctagagaaacgacaagtgattataatgg

SEQ ID NO: 978 - DNA, 33 bp, Artificial sequence
  Single strand DNA oligonucleotide
actgtcgacaacatgttgtttaactggactaag

SEQ ID NO: 979 - DNA, 31 bp, Artificial sequence
  Single strand DNA oligonucleotide
atggatccttacagaaccggtcaagatgaag

SEQ ID NO: 980 - DNA, 30 bp, Artificial sequence
  Single strand DNA oligonucleotide
atggatcccaataactcgaacacgaacaac

SEQ ID NO: 981 - DNA, 33 bp, Artificial sequence
  Single strand DNA oligonucleotide
tagatatcaacaatgattacagtagcccccttc

SEQ ID NO: 982 - DNA, 33 bp, Artificial sequence
  Single strand DNA oligonucleotide
atgatatcctaacaagcacaagactgatacagc

SEQ ID NO: 983 - DNA, 34 bp, Artificial sequence
  Single strand DNA oligonucleotide
atgatatccaaaagctagctactagtttcatcac

SEQ ID NO: 984 - DNA, 33 bp, Artificial sequence
  Single strand DNA oligonucleotide
atagtcgacgaaagaaagagaaagcagaacatg

SEQ ID NO: 985 - DNA, 30 bp, Artificial sequence
  Single strand DNA oligonucleotide
attctagatggaggagcaaatacaaacttg

SEQ ID NO: 986 - DNA, 31 bp, Artificial sequence
  Single strand DNA oligonucleotide
aatgtcgacgaaacttggttttgagcttaac

SEQ ID NO: 987 - DNA, 35 bp, Artificial sequence
  Single strand DNA oligonucleotide
attctagatcatcccattgctttctctagtattag

SEQ ID NO: 988 - DNA, 31 bp, Artificial sequence
  Single strand DNA oligonucleotide
attctagattaaatgtatcgctccaaaagac

SEQ ID NO: 989 - DNA, 31 bp, Artificial sequence
  Single strand DNA oligonucleotide
actgtcgacctaattctctccgtctcgatcg

SEQ ID NO: 990 - DNA, 33 bp, Artificial sequence
  Single strand DNA oligonucleotide
actgtcgacgactgattttacgctttattgctc

SEQ ID NO: 991 - DNA, 31 bp, Artificial sequence
  Single strand DNA oligonucleotide
gtgagctcttaaacaggtcatctcgagccac

SEQ ID NO: 992 - DNA, 29 bp, Artificial sequence
  Single strand DNA oligonucleotide
gagagctccgttgcctgacagaatctttg

SEQ ID NO: 993 - DNA, 33 bp, Artificial sequence
  Single strand DNA oligonucleotide
ataagcttattgattcctttaaagacttatgtt

SEQ ID NO: 994 - DNA, 32 bp, Artificial sequence
  Single strand DNA oligonucleotide
tcgtcgacgggtgtatgtttttaatcttgttt

SEQ ID NO: 995 - DNA, 29 bp, Artificial sequence
  Single strand DNA oligonucleotide
atctgcaggaaattggaaaagggtttaac

SEQ ID NO: 996 - DNA, 35 bp, Artificial sequence
  Single strand DNA oligonucleotide
attgtcgacgattagttcttgattcttgatctttc

SEQ ID NO: 997 - DNA, 33 bp, Artificial sequence
  Single strand DNA oligonucleotide
ataaagcttcattgacttgagattcagttcatg

SEQ ID NO: 998 - DNA, 33 bp, Artificial sequence
  Single strand DNA oligonucleotide
attgtcgacagagaagtgaatgaagattttagg

SEQ ID NO: 999 - DNA, 33 bp, Artificial sequence
  Single strand DNA oligonucleotide
aatgtcgaccgaatcaatacgtaactttcaatc

SEQ ID NO: 1000 - DNA, 30 bp, Artificial sequence
  Single strand DNA oligonucleotide
tatctagatgctttgttttgttttgttttg

SEQ ID NO: 1001 - DNA, 32 bp, Artificial sequence
  Single strand DNA oligonucleotide
actaagcttgacttgatactaacgaggaaatg

SEQ ID NO: 1002 - DNA, 31 bp, Artificial sequence
  Single strand DNA oligonucleotide
tgtgtcgactttcaaatttttagaatgggag

SEQ ID NO: 1003 - DNA, 29 bp, Artificial sequence
  Single strand DNA oligonucleotide
aactgcagagctcacgagtgtgtttttgg

SEQ ID NO: 1004 - DNA, 32 bp, Artificial sequence
  Single strand DNA oligonucleotide
attgtcgactgtatctgatcatatcttaccgg

SEQ ID NO: 1005 - DNA, 31 bp, Artificial sequence
  Single strand DNA oligonucleotide
attaagcttcctgcaacaatgatttattatg

SEQ ID NO: 1006 - DNA, 29 bp, Artificial sequence
  Single strand DNA oligonucleotide
tcccgggctaatattatgcacgcttcgtc

SEQ ID NO: 1007 - DNA, 30 bp, Artificial sequence
  Single strand DNA oligonucleotide
tataagcttcatctcggacttgatatcgtc

SEQ ID NO: 1008 - DNA, 31 bp, Artificial sequence
  Single strand DNA oligonucleotide
attgtcgacgaatcgaacaaacgaacataaa

What is claimed is:

1. A method of increasing oil in a plant, comprising:

(a) providing a plant transformed with a nucleic acid construct which comprises the nucleic acid sequence set forth in SEQ ID NOs:18 or 674, wherein said nucleic acid sequence encodes the polypeptide set forth in SEQ ID NO:68;

(b) expressing the polypeptide of SEQ ID NO: 68 in said transformed plant, and (c) extracting the oil from the transformed plant, and wherein said transformed plant has increased oil as compared to a wild-type plant of the same species.

2. The method of claim 1, wherein said nucleic acid sequence is operably linked to a heterologous promoter for directing transcription of said nucleic acid sequence in a plant cell of said transformed plant.

3. The method of claim 2, wherein said promoter comprises a nucleic acid sequence selected from the group consisting of SEQ ID NOs:779, 780, 781, 782, 783, 784, 785, 786, 787, 788, 789, 790, 791 and 792.

4. A method of increasing oil content, yield, growth rate, biomass, or tolerance salinity stress of a plant as compared to a wild type plant of the same species which is grown under the same growth conditions, comprising:

(a) transforming plants with an exogenous polynucleotide comprising a nucleic acid sequence encoding the polypeptide set forth in SEQ ID NO: 68; and (b) selecting a transformed plant from step (a) that expresses the tide of SEQ ID NO: 68 and exhibits increased oil content, increased yield, increased growth rate, increased biomass, or increased tolerance to salinity stress as compared to a wild type plant of the same species which is grown under the same growth conditions.

5. The method of claim 4, wherein said nucleic acid sequence encoding the polypeptide of SEQ ID NO: 68 set forth in SEQ ID NO: 18 or SEQ ID NO: 674.

6. The method of claim 1, further comprising growing the transformed plant expressing said exogenous polynucleotide encoding said polypeptide of SEQ ID NO: 68 under the salinity stress condition.

7. A method of producing a crop plant comprising:

(a) transforming parent plants with an exogenous polynucleotide encoding the polypeptide set forth in SEQ ID NO:68;

(b) obtaining a population of transgenic crop plants from step (a); and (c) selecting a transformed crop plant from step (b) which expresses the polypeptide of SEQ ID NO:68 encoded by said exogenous polynucleotide, and exhibits increased oil content, increased yield, increased growth rate, increased biomass, or increased tolerance to salinity stress as compared to a wild type plant of the same species which is grown under the same growth conditions.

8. The method of claim 7, wherein the transformed crop plant of step (c) is selected for increased tolerance to salinity stress as compared to a wild type plant of the same species which is grown under the same growth conditions.

9. The method of claim 7, wherein the transformed crop plant of step (c) is selected for increased oil content as compared to a wild type plant of the same species which is grown under the same growth conditions.

10. The method of claim 7, wherein the transformed crop plant of step (c) is selected for increased biomass as compared to a wild type plant of the same species which is grown under the same growth conditions.

* * * * *